(12) United States Patent
Goldman et al.

(10) Patent No.: US 12,075,786 B2
(45) Date of Patent: *Sep. 3, 2024

(54) MARKERS OF PLANT HEALTH

(71) Applicant: Indigo Ag, Inc., Boston, MA (US)

(72) Inventors: Barry S. Goldman, Cambridge, MA (US); Max E. Winston, Somerville, MA (US); Allison Perrotta, Somerville, MA (US)

(73) Assignee: Indigo Ag, Inc., Boston, MA (US)

( * ) Notice: Subject to any disclaimer, the term of this patent is extended or adjusted under 35 U.S.C. 154(b) by 409 days.

This patent is subject to a terminal disclaimer.

(21) Appl. No.: 16/134,720

(22) Filed: Sep. 18, 2018

(65) Prior Publication Data

US 2019/0085352 A1 Mar. 21, 2019

Related U.S. Application Data

(60) Provisional application No. 62/651,033, filed on Mar. 30, 2018, provisional application No. 62/560,124, filed on Sep. 18, 2017.

(51) Int. Cl.
| | |
|---|---|
| *A01N 63/27* | (2020.01) |
| *A01H 3/00* | (2006.01) |
| *A01H 17/00* | (2006.01) |
| *A01N 63/20* | (2020.01) |
| *A01N 63/22* | (2020.01) |
| *A01N 63/25* | (2020.01) |
| *A01N 63/28* | (2020.01) |
| *C12N 1/20* | (2006.01) |
| *C12N 15/10* | (2006.01) |
| *C12N 15/82* | (2006.01) |
| *C12Q 1/06* | (2006.01) |
| *C12Q 1/689* | (2018.01) |
| *C12Q 1/6895* | (2018.01) |

(52) U.S. Cl.
CPC ............... *A01N 63/27* (2020.01); *A01H 3/00* (2013.01); *A01H 17/00* (2013.01); *A01N 63/20* (2020.01); *A01N 63/22* (2020.01); *A01N 63/25* (2020.01); *A01N 63/28* (2020.01); *C12N 1/20* (2013.01); *C12N 15/1068* (2013.01); *C12N 15/1075* (2013.01); *C12N 15/1079* (2013.01); *C12N 15/8261* (2013.01); *C12Q 1/06* (2013.01); *C12Q 1/689* (2013.01); *C12Q 1/6895* (2013.01)

(58) Field of Classification Search
None
See application file for complete search history.

(56) References Cited

U.S. PATENT DOCUMENTS

| | | | |
|---|---|---|---|
| 2,200,532 | A | 5/1940 | Bond |
| 4,642,131 | A | 2/1987 | Hoitink |
| 4,940,834 | A | 7/1990 | Hurley et al. |
| 5,041,290 | A | 8/1991 | Gindrat et al. |
| 5,113,619 | A | 5/1992 | Leps et al. |
| 5,229,291 | A | 7/1993 | Nielsen et al. |
| 5,292,507 | A | 3/1994 | Charley |
| 5,300,127 | A | 4/1994 | Williams |
| 5,415,672 | A | 5/1995 | Fahey et al. |
| 5,730,973 | A | 3/1998 | Morales et al. |
| 5,919,447 | A | 7/1999 | Marrone et al. |
| 5,989,543 | A | 11/1999 | Davide et al. |
| 5,994,117 | A | 11/1999 | Bacon et al. |
| 6,072,107 | A | 6/2000 | Latch et al. |
| 6,077,505 | A | 6/2000 | Parke et al. |
| 6,337,431 | B1 | 1/2002 | Tricoli et al. |
| 6,495,133 | B1 | 12/2002 | Xue |
| 6,602,500 | B1 | 8/2003 | Kharbanda et al. |
| 6,681,186 | B1 | 1/2004 | Denisov et al. |
| 6,689,880 | B2 | 2/2004 | Chen et al. |
| 6,823,623 | B2 | 11/2004 | Minato et al. |
| 7,037,879 | B2 | 5/2006 | Imada et al. |
| 7,080,034 | B1 | 7/2006 | Reams |
| 7,084,331 | B2 | 8/2006 | Isawa et al. |
| 7,335,816 | B2 | 2/2008 | Kraus et al. |
| 7,341,868 | B2 | 3/2008 | Chopade et al. |
| 7,435,411 | B2 | 10/2008 | Park et al. |
| 7,485,451 | B2 | 2/2009 | VanderGheynst et al. |
| 7,555,990 | B2 | 7/2009 | Beaujot |
| 7,632,985 | B2 | 12/2009 | Malven et al. |
| 7,763,420 | B2 | 7/2010 | Stritzker et al. |
| 7,906,313 | B2 | 3/2011 | Henson et al. |
| 7,977,550 | B2 | 7/2011 | West et al. |
| 8,019,694 | B2 | 9/2011 | Fell et al. |
| 8,143,045 | B2 | 3/2012 | Miasnikov et al. |

(Continued)

FOREIGN PATENT DOCUMENTS

| | | |
|---|---|---|
| AU | 2015201322 | 4/2015 |
| CA | 1041788 A | 11/1978 |

(Continued)

OTHER PUBLICATIONS

Buee, et al. ("The rhizosphere zoo: an overview of plant-associated communities of microorganisms, including phages, bacteria, archaea, and fungi, and of some of their structuring factors." (2009): 189-212). (Year: 2009).*

(Continued)

*Primary Examiner* — Charles Logsdon
(74) *Attorney, Agent, or Firm* — K&L Gates LLP

(57) ABSTRACT

This invention relates to methods and compositions for improving plant health. The present invention includes methods for making an enriched library of treatments capable of improving plant health, methods for an making an enriched library of plants capable of being improved by a treatment, and methods of marketing a plant treatment, as well as synthetic compositions comprising treatments produced by the methods of the present invention, synthetic compositions comprising endophytes capable of improving plant health, and nucleic acid probes and nucleic acid detection kits that may be used in the methods of the present invention.

12 Claims, 24 Drawing Sheets

Specification includes a Sequence Listing.

(56) References Cited

U.S. PATENT DOCUMENTS

| | | |
|---|---|---|
| 8,455,198 B2 | 6/2013 | Gao et al. |
| 8,455,395 B2 | 6/2013 | Miller et al. |
| 8,465,963 B2 | 6/2013 | Rolston et al. |
| 8,728,459 B2 | 5/2014 | Isawa et al. |
| 8,975,489 B2 | 3/2015 | Craven |
| 9,049,814 B2 | 6/2015 | Marx et al. |
| 9,113,636 B2 | 8/2015 | von Maltzahn et al. |
| 9,277,751 B2 | 3/2016 | Sword |
| 9,288,995 B2 | 3/2016 | von Maltzahn et al. |
| 9,295,263 B2 | 3/2016 | von Maltzahn et al. |
| 9,364,005 B2 | 6/2016 | Mitter et al. |
| 9,408,394 B2 | 8/2016 | von Maltzahn et al. |
| 9,532,572 B2 | 1/2017 | von Maltzahn et al. |
| 9,532,573 B2 | 1/2017 | von Maltzahn et al. |
| 9,545,111 B2 | 1/2017 | Sword |
| 9,622,485 B2 | 4/2017 | von Maltzahn et al. |
| 9,652,840 B1 | 5/2017 | Shriver et al. |
| 9,687,001 B2 | 6/2017 | Vujanovic et al. |
| 9,756,865 B2 | 9/2017 | Sword |
| 10,058,101 B2 | 8/2018 | von Maltzahn et al. |
| 10,076,120 B2 | 9/2018 | von Maltzahn et al. |
| 10,104,862 B2 | 10/2018 | Vujanovic et al. |
| 10,136,646 B2 | 11/2018 | Von Maltzahn et al. |
| 10,212,911 B2 | 2/2019 | von Maltzahn et al. |
| 10,212,912 B2 | 2/2019 | Vujanovic et al. |
| 10,212,940 B2 | 2/2019 | Ambrose et al. |
| 10,212,944 B2 | 2/2019 | Ambrose et al. |
| 10,271,554 B2 | 4/2019 | Mitter et al. |
| 10,306,890 B2 | 6/2019 | Mitter et al. |
| 10,362,787 B2 | 7/2019 | Mitter et al. |
| 10,492,497 B2 | 12/2019 | von Maltzahn et al. |
| 10,499,652 B2 | 12/2019 | von Maltzahn et al. |
| 10,499,653 B2 | 12/2019 | von Maltzahn et al. |
| 10,499,654 B2 | 12/2019 | von Maltzahn et al. |
| 10,640,783 B2 | 5/2020 | Riley |
| 10,645,938 B2 | 5/2020 | Riley |
| 10,667,523 B2 | 6/2020 | Ambrose et al. |
| 10,750,711 B2 | 8/2020 | Djonovic et al. |
| 10,912,303 B2 | 2/2021 | Von Maltzahn et al. |
| 10,932,469 B2 | 3/2021 | Mitter et al. |
| 11,064,702 B2 | 7/2021 | Ambrose et al. |
| 11,119,086 B2 | 9/2021 | Mitter et al. |
| 11,151,379 B2 | 10/2021 | Freitag et al. |
| 11,166,465 B2 | 11/2021 | von Maltzahn et al. |
| 11,197,457 B2 | 12/2021 | Ambrose et al. |
| 11,254,908 B2 | 2/2022 | Mitter et al. |
| 11,570,993 B2 | 2/2023 | von Maltzahn et al. |
| 11,747,316 B2 | 9/2023 | Mitter et al. |
| 11,751,515 B2 | 9/2023 | von Maltzahn |
| 11,751,571 B2 | 9/2023 | Ambrose et al. |
| 11,753,618 B2 | 9/2023 | Mitter et al. |
| 11,793,202 B2 | 10/2023 | von Maltzahn et al. |
| 2001/0032162 A1 | 10/2001 | Alsberg et al. |
| 2002/0059091 A1 | 5/2002 | Hay et al. |
| 2002/0120555 A1 | 8/2002 | Lerner |
| 2002/0142917 A1 | 10/2002 | Triplett et al. |
| 2002/0147670 A1 | 10/2002 | Lange |
| 2003/0050901 A1 | 3/2003 | Jester et al. |
| 2003/0195822 A1 | 10/2003 | Tatge et al. |
| 2003/0236738 A1 | 12/2003 | Lange et al. |
| 2005/0008619 A1 | 1/2005 | Park et al. |
| 2005/0070435 A1 | 3/2005 | Chopade et al. |
| 2005/0072047 A1 | 4/2005 | Conkling et al. |
| 2006/0046246 A1 | 3/2006 | Zeng et al. |
| 2006/0178269 A1 | 8/2006 | Medina-Vega |
| 2006/0185207 A1 | 8/2006 | Mitcheltree |
| 2007/0028318 A1 | 2/2007 | Livore et al. |
| 2007/0055456 A1 | 3/2007 | Raftery et al. |
| 2007/0142226 A1 | 6/2007 | Franco |
| 2007/0292953 A1 | 12/2007 | Mankin et al. |
| 2008/0229441 A1 | 9/2008 | Young et al. |
| 2008/0289060 A1 | 11/2008 | De Beuckeleer et al. |
| 2009/0155214 A1 | 6/2009 | Isawa et al. |
| 2009/0300781 A1 | 12/2009 | Bancroft et al. |
| 2010/0064392 A1 | 3/2010 | Yang et al. |
| 2010/0095396 A1 | 4/2010 | Voeste et al. |
| 2010/0114753 A1 | 5/2010 | Osmanski et al. |
| 2010/0130365 A1 | 5/2010 | Notten et al. |
| 2010/0205690 A1 | 8/2010 | Blasing et al. |
| 2010/0227357 A1 | 9/2010 | Redman et al. |
| 2011/0033436 A1 | 2/2011 | Chen et al. |
| 2011/0182862 A1 | 7/2011 | Green et al. |
| 2011/0195406 A1 | 8/2011 | Sorenson et al. |
| 2012/0108431 A1 | 5/2012 | Williams et al. |
| 2012/0116943 A1 | 5/2012 | Abramson |
| 2012/0131696 A1 | 5/2012 | Aayal et al. |
| 2012/0144533 A1 | 6/2012 | Craven |
| 2012/0149571 A1 | 6/2012 | Kloepper et al. |
| 2012/0178624 A1 | 7/2012 | Kaminskyj et al. |
| 2012/0324599 A1 | 12/2012 | Kerns et al. |
| 2013/0031673 A1 | 1/2013 | Grandlic et al. |
| 2013/0071425 A1 | 3/2013 | Vidal et al. |
| 2013/0079225 A1 | 3/2013 | Smith et al. |
| 2013/0150240 A1 | 6/2013 | Newman et al. |
| 2013/0233501 A1 | 9/2013 | Van Zyl et al. |
| 2014/0020136 A1 | 1/2014 | Van Der Wolf et al. |
| 2014/0109249 A1 | 4/2014 | Turner et al. |
| 2014/0115731 A1 | 4/2014 | Turner et al. |
| 2014/0134629 A1 | 5/2014 | Turner et al. |
| 2014/0147425 A1 | 5/2014 | Henn et al. |
| 2014/0342905 A1 | 11/2014 | Bullis et al. |
| 2015/0020239 A1 | 1/2015 | von Maltzahn et al. |
| 2015/0033420 A1 | 1/2015 | Rodriguez et al. |
| 2015/0126365 A1 | 5/2015 | Sword |
| 2015/0218568 A1 | 8/2015 | Jones et al. |
| 2015/0230478 A1 | 8/2015 | Vujanovic et al. |
| 2015/0242970 A1 | 8/2015 | Avey et al. |
| 2015/0282490 A1 | 10/2015 | Wachendorff-Neumann et al. |
| 2015/0289518 A1 | 10/2015 | Andersch et al. |
| 2015/0296802 A1 | 10/2015 | Wachendorff-Neumann et al. |
| 2015/0296803 A1 | 10/2015 | Andersch et al. |
| 2015/0296804 A1 | 10/2015 | Andersch et al. |
| 2015/0305348 A1 | 10/2015 | Andersch et al. |
| 2015/0320050 A1* | 11/2015 | von Maltzahn ........ A01N 63/20 504/117 |
| 2015/0320051 A1 | 11/2015 | Wachendorff-Neumann et al. |
| 2015/0335029 A1 | 11/2015 | Mitter et al. |
| 2015/0342199 A1 | 12/2015 | Carrion Villanovo et al. |
| 2015/0366217 A1 | 12/2015 | Vujanovic et al. |
| 2015/0368607 A1 | 12/2015 | Arnold et al. |
| 2015/0370935 A1 | 12/2015 | Starr |
| 2015/0373993 A1 | 12/2015 | von Maltzahn et al. |
| 2016/0000091 A1 | 1/2016 | Andersch et al. |
| 2016/0021891 A1 | 1/2016 | von Maltzahn et al. |
| 2016/0150796 A1 | 6/2016 | von Maltzahn et al. |
| 2016/0174570 A1 | 6/2016 | Vujanovic et al. |
| 2016/0192662 A1 | 7/2016 | Sword |
| 2016/0205947 A1 | 7/2016 | Sword |
| 2016/0235074 A1 | 8/2016 | von Maltzahn et al. |
| 2016/0255844 A1 | 9/2016 | Mitter et al. |
| 2016/0260021 A1 | 9/2016 | Marek |
| 2016/0286821 A1 | 10/2016 | Sword |
| 2016/0290918 A1 | 10/2016 | Xu et al. |
| 2016/0316760 A1* | 11/2016 | Ambrose ............... A01G 22/35 |
| 2016/0316763 A1 | 11/2016 | Sword |
| 2016/0330976 A1 | 11/2016 | Mitter et al. |
| 2016/0338360 A1 | 11/2016 | Mitter et al. |
| 2016/0350855 A1 | 12/2016 | Lerner |
| 2016/0366892 A1 | 12/2016 | Ambrose et al. |
| 2017/0020138 A1 | 1/2017 | Von Maltzahn et al. |
| 2017/0064361 A1 | 3/2017 | Pinca, IV et al. |
| 2017/0161560 A1 | 6/2017 | Itzhaky et al. |
| 2017/0164619 A1 | 6/2017 | von Maltzahn et al. |
| 2017/0164620 A1 | 6/2017 | von Maltzahn et al. |
| 2017/0215358 A1 | 8/2017 | Franco et al. |
| 2017/0223967 A1 | 8/2017 | Mitter et al. |
| 2018/0020677 A1 | 1/2018 | Ambrose et al. |
| 2018/0060771 A1 | 3/2018 | Mangin |
| 2018/0092365 A1 | 4/2018 | Sword |
| 2018/0153174 A1 | 6/2018 | Riley et al. |
| 2018/0177196 A1 | 6/2018 | Sword |
| 2018/0189564 A1 | 7/2018 | Freitag et al. |
| 2018/0213800 A1 | 8/2018 | Djonovic et al. |
| 2018/0249716 A1 | 9/2018 | Riley |

(56) References Cited

U.S. PATENT DOCUMENTS

| | | |
|---|---|---|
| 2018/0251776 A1 | 9/2018 | Riley |
| 2018/0322426 A1 | 11/2018 | Schmaltz et al. |
| 2019/0130999 A1 | 5/2019 | Oppenheim et al. |
| 2021/0076685 A1 | 3/2021 | Ambrose et al. |
| 2021/0372997 A1 | 12/2021 | Von Maltzahn et al. |
| 2023/0288391 A1 | 9/2023 | Mitter et al. |
| 2023/0329244 A1 | 10/2023 | von Maltzahn et al. |

FOREIGN PATENT DOCUMENTS

| | | |
|---|---|---|
| CA | 1229497 A | 11/1987 |
| CA | 2562175 A1 | 4/2008 |
| CA | 2916678 A1 | 12/2014 |
| CA | 2960032 A1 | 3/2015 |
| CA | 2935218 A1 | 7/2015 |
| CA | 2953466 A1 | 12/2015 |
| CA | 2953697 A1 | 12/2015 |
| CN | 1604732 A | 4/2005 |
| CN | 1948459 A | 4/2007 |
| CN | 101311262 A | 11/2008 |
| CN | 101423810 A | 5/2009 |
| CN | 101570738 A | 11/2009 |
| CN | 101693881 A | 4/2010 |
| CN | 102010835 A | 4/2011 |
| CN | 102123596 A | 7/2011 |
| CN | 102168022 A | 8/2011 |
| CN | 102352327 A | 2/2012 |
| CN | 102533601 A | 7/2012 |
| CN | 103642725 A | 3/2014 |
| CN | 103865837 | 6/2014 |
| CN | 104250616 A | 12/2014 |
| CN | 104388356 A | 3/2015 |
| CN | 104560742 A | 4/2015 |
| CN | 105274008 A | 1/2016 |
| CN | 105886428 | 8/2016 |
| CN | 106434493 | 2/2017 |
| EP | 0192342 A2 | 8/1986 |
| EP | 0223662 A1 | 5/1987 |
| EP | 0378000 A2 | 7/1990 |
| EP | 0494802 A1 | 7/1992 |
| EP | 0818135 A1 | 1/1998 |
| EP | 1389767 | 2/2004 |
| EP | 1621632 A1 | 2/2006 |
| EP | 1935245 A1 | 6/2008 |
| EP | 1967057 | 9/2008 |
| EP | 2114118 | 9/2012 |
| EP | 2676536 A1 | 12/2013 |
| EP | 2959779 | 12/2015 |
| EP | 3041338 | 7/2016 |
| EP | 3659414 | 6/2020 |
| JP | 2003300804 A | 10/2003 |
| JP | 2009/072168 A | 4/2009 |
| KR | 20050039979 | 5/2005 |
| KR | 20100114806 A | 10/2010 |
| KR | 101056546 B1 | 8/2011 |
| KR | 101066283 | 9/2011 |
| KR | 101091151 B1 | 12/2011 |
| KR | 20120004958 | 1/2012 |
| KR | 20130023491 A | 3/2013 |
| RU | 2043028 C1 | 9/1995 |
| WO | 1988/009114 | 1/1988 |
| WO | 1994/016076 | 7/1994 |
| WO | 98/35017 | 8/1998 |
| WO | 99/59412 | 11/1999 |
| WO | 2000/029607 A1 | 5/2000 |
| WO | 2001/046774 | 12/2000 |
| WO | 2001/083697 A2 | 11/2001 |
| WO | 2001/083818 A2 | 11/2001 |
| WO | 2002/065836 A2 | 8/2002 |
| WO | 2003/038066 | 5/2003 |
| WO | 2004/046357 A1 | 6/2004 |
| WO | 2005/003328 A1 | 1/2005 |
| WO | 2007/021200 A1 | 2/2007 |
| WO | 2007/107000 A1 | 9/2007 |
| WO | 2008/103422 A2 | 8/2008 |
| WO | 2008/107097 | 9/2008 |
| WO | 2009/012480 A2 | 1/2009 |
| WO | 2009/078710 A1 | 6/2009 |
| WO | 2009/126473 A1 | 10/2009 |
| WO | 2010/109436 A1 | 9/2010 |
| WO | 2010/115156 A2 | 10/2010 |
| WO | 2011/001127 A1 | 1/2011 |
| WO | 2011/011627 A1 | 1/2011 |
| WO | 2011/082455 A1 | 7/2011 |
| WO | 2011/112781 A2 | 9/2011 |
| WO | 2011/117351 A1 | 9/2011 |
| WO | 2012/016140 | 2/2012 |
| WO | 2012/034996 A1 | 3/2012 |
| WO | 2013/016361 A2 | 1/2013 |
| WO | 2013/029112 A1 | 3/2013 |
| WO | 2013/054272 | 4/2013 |
| WO | 2013/090628 A1 | 6/2013 |
| WO | 2013/122473 A1 | 8/2013 |
| WO | 2013/148290 | 10/2013 |
| WO | 2013/177615 A1 | 12/2013 |
| WO | 2013/190082 A1 | 12/2013 |
| WO | 2014/046553 A1 | 3/2014 |
| WO | 2014/079728 | 5/2014 |
| WO | 2014/082950 A1 | 6/2014 |
| WO | 2014/086747 | 6/2014 |
| WO | 2014/086749 | 6/2014 |
| WO | 2014/086750 | 6/2014 |
| WO | 2014/086752 | 6/2014 |
| WO | 2014/086753 | 6/2014 |
| WO | 2014/086756 | 6/2014 |
| WO | 2014/086758 | 6/2014 |
| WO | 2014/086759 | 6/2014 |
| WO | 2014/086764 | 6/2014 |
| WO | 2014/086776 | 6/2014 |
| WO | 2014/121366 A1 | 8/2014 |
| WO | 2014/206953 A1 | 12/2014 |
| WO | 2014/210372 A1 | 12/2014 |
| WO | 2015/035099 A1 | 3/2015 |
| WO | 2015/069938 A1 | 5/2015 |
| WO | 2015069708 A1 | 5/2015 |
| WO | 2015/100431 A2 | 7/2015 |
| WO | 2015/100432 A2 | 7/2015 |
| WO | 2015/114552 | 8/2015 |
| WO | 2015/116838 | 8/2015 |
| WO | 2015/192172 A1 | 12/2015 |
| WO | 2015/200852 A2 | 12/2015 |
| WO | 2015/200902 A2 | 12/2015 |
| WO | 2016020371 | 2/2016 |
| WO | 2016/050726 | 4/2016 |
| WO | 2016/057991 A1 | 4/2016 |
| WO | 2016/090212 A1 | 6/2016 |
| WO | 2016/109758 A2 | 7/2016 |
| WO | 2016/179046 A1 | 11/2016 |
| WO | 2016/179047 A1 | 11/2016 |
| WO | 2016/200987 A1 | 12/2016 |
| WO | 2017112827 A1 | 6/2017 |
| WO | 2018094027 | 5/2018 |
| WO | 2018/119419 | 6/2018 |
| WO | 2018102733 A1 | 6/2018 |
| WO | 2018160244 A1 | 9/2018 |
| WO | 2018160245 A1 | 9/2018 |
| WO | 2019/046909 | 3/2019 |
| WO | 2019055968 A2 | 3/2019 |
| WO | 2019084380 | 5/2019 |
| WO | 2019113468 | 6/2019 |

OTHER PUBLICATIONS

Hanapi, et al. ("Biofertilizer: Ingredients for Sustainable Agriculture." Biotechnology Development in Agriculture, Industry and Health: Current Industrial Application and Future Trends 1 (2012): 359-385). (Year: 2012).*

Singh ("Screening and characterization of plant growth promoting rhizobacteria (PGPR): An overview." Bulletin of Environmental and Scientific Research 4.1-2 (2015): 1-2). (Year: 2016).*

United States Patent Office, Non-Final Office Action, U.S. Appl. No. 14/766,065, filed Oct. 27, 2017, 11 Pages.

(56) References Cited

OTHER PUBLICATIONS

United States Patent Office, Non-Final Office Action, U.S. Appl. No. 14/964,429, filed Aug. 9, 2016, 6 Pages.
United States Patent Office, Final Office Action, U.S. Appl. No. 14/964,429, filed May 31, 2017, 9 Pages.
United States Patent Office, Non-Final Office Action, U.S. Appl. No. 15/212,038, filed Sep. 21, 2016, 10 Pages.
United States Patent Office, Non-Final Office Action, U.S. Appl. No. 15/063,350, filed Nov. 10, 2016, 18 Pages.
United States Patent Office, Final Office Action, U.S. Appl. No. 14/614,193, filed Dec. 22, 2016, 13 Pages.
United States Patent Office, Final Office Action, U.S. Appl. No. 14/614,193, filed Jul. 18, 2017, 14 Pages.
United States Patent Office, Final Office Action, U.S. Appl. No. 14/614,193, filed May 3, 2018, 10 Pages.
United States Patent Office, Non-Final Office Action, U.S. Appl. No. 15/107,973, filed Apr. 10, 2017, 39 Pages.
United States Patent Office, Final Office Action, U.S. Appl. No. 15/107,973, filed Jan. 26, 2018, 20 Pages.
United States Patent Office, Final Office Action, U.S. Appl. No. 14/410,537, filed May 5, 2017, 9 Pages.
United States Patent Office, Non-Final Office Action, U.S. Appl. No. 15/034,862, filed May 19, 2017, 8 Pages.
United States Patent Office, Final Office Action, U.S. Appl. No. 15/034,862, filed Jan. 12, 2018, 14 Pages.
United States Patent Office, Non-Final Office Action, U.S. Appl. No. 15/436,592, filed Aug. 30, 2017, 17 Pages.
United States Patent Office, Non-Final Office Action, U.S. Appl. No. 15/436,609, filed Aug. 30, 2017, 21 Pages.
United States Patent Office, Non-Final Office Action, U.S. Appl. No. 14/916,514, filed Sep. 20, 2017, 31 Pages.
United States Patent Office, Non-Final Office Action, U.S. Appl. No. 15/143,398, filed Sep. 22, 2017, 17 Pages.
United States Patent Office, Non-Final Office Action, U.S. Appl. No. 15/143,394, filed Sep. 25, 2017, 15 Pages.
United States Patent Office, Non-Final Office Action, U.S. Appl. No. 15/107,965, filed Jun. 21, 2018, 27 Pages.
Abarenkov, K., et al., "The UNITE Database for Molecular Identification of Fungi—Recent Updates and Future Perspectives," New Phytol., 2010, pp. 281-285, vol. 186.
Abdellatif, L., et al., "Endophytic hyphal compartmentalization is required for successful symbiotic Ascomycota association with root cells," Mycological Research, 2009, pp. 782-791, vol. 113.
Abdellatif, L., et al., "Characterization of virulence and PCR-DGGE profiles of Fusarium avenaceum from western Canadian Prairie Ecozone of Saskatchewan," Canadian Journal of Plant Pathology, 2010, pp. 468-480.
Abello, J., et al., "Agrobacterium-mediated transformation of the endophytic fungus *Acremonium implicatum* associated with Brachiaria grasses", Mycological Research, pp. 407-413, vol. 112, Pt 3.
Abdou, R., et al., "Botryorhodines A-D, antifungal and cytotoxic depsidones from Botryosphaeria rhodina, an endophyte of the medicinal plant *Bidens pilosa*," Phytochemistry, 2010, vol. 71, pp. 110-116.
Abou-Shanab, R.A., et al: "Characterization of Ni-resistant bacteria in the rhizosphere of the hyperaccumulator Alyssum murale by 16S rRNA gene sequence analysis", World Journal of Microbiology and Biotechnology, vol. 26, No. 1, Aug. 15, 2009, pp. 101-108.
Adhikari, M., et al., "A New Record of Pseudeurotium bakeri from Crop Field Soil in Korea," The Korean Journal of Mycology, 2016, pp. 145-149, vol. 44.
Ahmad, F., et al., "Screening of Free-Living Rhizospheric Bacteria for Their Multiple Plant Growth Promotinq Activities," Microbiol Res., 2008, pp. 173-181, vol. 163.
Al-Askar AA, "Microbiological studies on the in vitro inhibitory effect of Streptomyces collinus albescens against some phytopathogenic fungi", African Journal of Microbiology Research, 2012, 6: 3277-3283 & GenBank Accession No. AB184101, May 20, 2008.
Amann, R., et al., "The Identification of Microorganisms by Fluorescence in Situ Hybridisation," Curr Opin Biotechnol., 2001, pp. 231-236, vol. 12.
Amatuzzi, R.F., et al., "Universidade Federal do Parana," Jan. 1, 2014, 52 Pages. (With English Abstract).
Amatuzzi, R.F., et al., "Potential of endophytic fungi as biocontrol agents of Duponchelia fovealis (Zeller) (Lepidoptera:Crambidae)," Brazilian Journal of Biology, Nov. 9, 2017, 7 Pages.
Antony-Badu, S., et al., "Multiple Streptomyces species with distinct secondary metabolomes have identical 16S rRNA gene sequences." Scientific Reports 7.1, Sep. 2017, No. 7, 11089, pp. 1-8.
Apel, K., et al., "Reactive Oxygen Species: Metabolism, Oxidative Stress, and Signal Transduction," Annu Rev Plant Biol., 2004, pp. 373-399, vol. 55.
Ardakani, M.R. et al., "Absorption of N, P, K thorugh triple inoculation of wheat (*Triticum aestivum* L.) by Azospirillum brasilense, *Streptomyces* sp., Glomus intraradices and manure application," Physiol Mol Biol Plants, 2011, vol. 17, No. 2, pp. 181-192.
Arendt, K. R., et al., "Isolation of endohyphal bacteria from foliar Ascomycota and in vitro establishment of their symbiotic associations," Appl. Environ. Microbiol., 2016, pp. 2943-2949, vol. 82, No. 10.
Artursson, V., et al., "Interactions between arbuscular mycorrhizal fungi and bacteria and their potential for stimulating plant growth", Environmental Microbiology, vol. 8, No. 1, Jan. 1, 2006, pp. 1-10.
Ashrafuzzaman, M., et al., "Efficiency of plant growth-promoting rhizobacteria (PGPR) for the enhancement of rice growth," African Journal of Biotechnology, 2009, pp. 1247-1252, vol. 8, No. 7.
Aveskamp, M., et al., "DNA phylogeny reveals polyphyly of Phoma section Peyronellaea and multiple taxonomic novelties," Mycologia, 2009, vol. 101, No. 3, pp. 363-382.
Azcon, R., et al., "Selective interactions between different species of mycorrhizal fungi and Rhizobium meliloti strains, and their effects on growth, N2-fixation (15N) and nutrition of Medicago sativa L.," New Phytol., 1991, vol. 117, pp. 399-404.
Bacon, C. W, et al., "Isolation, In Planta Detection, and Uses of Endophytic Bacteria for Plant Protection," Manual of Environmental Microbiology, 2007, pp. 638-647.
Baker, K. F., et al., "Dynamics of Seed Transmission of Plant Pathogens," Annu Rev. Phytopathol., 1966, pp. 311-334, vol. 4.
Baltruschat, H., et al., "Salt tolerance of barley induced by the root endophyte *Piriformospora indica* is associated with a strong increase in antioxidants," New Phytologist., 2008, pp. 501-510, vol. 180.
Bandara, WM.M.S., et al., "Interactions among endophytic bacteria and fungi: effects and potentials" Journal of Biosciences, Dec. 2006, vol. 31, No. 5, pp. 645-650.
Barnett, S., et al., "Selection of microbes for control of Rhizoctonia root rot on wheat using a high throughput pathosystem", Biological Control, Jul. 6, 2017, 113: 45-57.
Bashan, Yoav Ed, et al., "Inoculants of plant growth-promoting bacteria for use in agriculture," Biotechnology Advances, Elsevier Publishing, Barking, GB, vol. 16, No. 4, Jul. 1, 1998, pp. 729-770, XP004123985.
Bashan, Yoav E., et al., "Alginate Beads as Synthetic Inoculant Carriers for Slow Release of Bacteria that Affect Plant Growth," Applied and Environmental Microbiology, pp. 1089-1098, May 1986.
Bensch, K., et al., "Species and ecological diversity within the Cladosporium cladosporioides complex (Davidiellaceae, Capnodiales)," Studies in Mycology, 2010, pp. 1-94, vol. 67.
Bethlenfalvay, G., et al., "Mycorrhizal fungi effects on nutrient composition and yield of soybean seeds", Journal of Plant Nutrition, vol. 20, pp. 4-5, Apr. 1, 1997, pp. 581-591.
Bing, LA, et al., "Suppression of Ostrinia nubilalis (Hübner) (Lepidoptera: Pyralidae) by endophytic *Beauveria bassiana* (Balsamo) Vuillemin", Environmental Entomol, Entomological Society of America, College Park, MD, US, vol. 20, Jan. 1, 1991, pp. 1207-1211.
Block, C. C., et al., "Seed Transmission of Pantoea stewartii in Field and Sweet Corn," Plant Disease, 1998, pp. 775-780, vol. 82.

(56) References Cited

OTHER PUBLICATIONS

Normander, B., et al., "Bacterial Origin and Community Composition in the Barley Phytosphere as a Function of Habitat and Presowing Conditions," Appl Environ Microbiol., Oct. 2000, pp. 4372-4377, vol. 66, No. 10.
Ogbo, F., et al., "Some Characteristics of a Plant Growth Promoting; iEnterobacter/isp. Isolated from the Roots of Maize", Advances in Microbiology, Jan. 1, 2012, vol. 02, No. 03, pp. 368-374.
O'Hanlon, K., et al., "Exploring the potential of symbiotic fungal endophytes in cereal disease suppression", Biological Control, vol. 63, No. 2, Sep. 5, 2012, pp. 69-78.
Okunishi, S., et al., "Bacterial Flora of Endophytes in the Maturing Seeds of Cultivated Rice (*Oryza sativa*)," Microbes and Environment, 2005, pp. 168-177, vol. 20, No. 3.
Op De Beeck, M., et al., "Comparison and Validation of Some ITS Primer Pairs Useful for Fungal Metabarcoding Studies," PLOS ONE, Jun. 2014, vol. 9, Issue 6, e97629, pp. 1-11.
Orakçi GE et al, "Selection of antagonistic actinomycete isolates as biocontrol agents against root-rot fungi", Fresenius Environmental Bulletin, 2010, 19: 417-424 & GenBank Accession No. GQ475299, Oct. 5, 2009.
Orole, O. O., et al., "Bacterial and fungal endophytes associated with grains and roots of maize," Journal of Ecology and the Natural Environment, 2011, pp. 298-303, vol. 3, No. 9.
Partida-Martinez, L.P., et al., "The Microbe-Free Plant: Fact or Artifact?" Front Plant Sci., 2011, vol. 2, No. 100, 16 Pages.
Partida-Martinez, L.P., et al., "Endosymbiont-Dependent Host Reproduction Maintains Bacterial-Fungal Mutualism", Current Biology, May 1, 2007, vol. 17, No. 9, pp. 773-777.
Pearson, W.R., et al., "Rapid and Sensitive Sequence Comparison With FASTP and FASTA," Methods Enzymol., 2011, pp. 63-98, vol. 183.
Pedraza, R.O., et al., "Azospirillum inoculation and nitrogen fertilization effect on grain yield and on the diversity of endophytic bacteria in the phyllosphere of rice rainfed crop," European Journal of Soil Biology, 2009, pp. 36-43, vol. 45.
Perez-Fernandez, M.A., et al., "Simulation of Germination of Pioneer Species Along an Experimental Drought Gradient," J Environ Biol., 2006, pp. 669-685, vol. 27, No. 4.
Perez-Miranda, S., et al., "O-CAS, A Fast and Universal Method for Siderophore Detection," J Microbiol Methods, 2007, pp. 127-131, vol. 70.
Petti, C. A., "Detection and Identification of Microorganisms by Gene Amplification and Sequencing," Clinical Infectious Diseases, 2007, pp. 1108-1114, vol. 44.
Philippot, L., et al., "Going Back to the Roots: The Microbial Ecology of the Rhizosphere," Nat Rev Microbiol., Nov. 2013, pp. 789-799, vol. 11.
Philrice Batac, Philippine Rice R&D Highlights, 2012, Area-Based R&D Projects, [online][Retrieved Aug. 11, 2016] Retrieved from the Internet URL:http://www.philrice.gov.ph/2012-rd-highlights/, 52 Pages.
Pillay, V. K., et al., "Inoculum Density, Temperature, and Genotype Effects on in vitro Growth Promotion and Epiphytic and Endophytic Colonization of Tomato (*Lycopersicon esculentum* L.) Seedlings Inoculated with a Pseudomonad Bacterium," Can J Microbiol., 1997, pp. 354-361, vol. 43.
Powell, W. A., et al., "Evidence of Endophytic Beauveria Bassiana in Seed-Treated Tomato Plants Acting as a Systemic Entomopathogen to Larval Helicoverpa zea (Lepidoptera: Noctuidae)," J. Entomol. Sci., 2009, pp. 391-396, vol. 44, No. 4.
Quadt-Hallmann, A, et al., "Bacterial Endophytes in Cotton: Mechanisms of Entering the Plant," Can J Microbiol., 1997, pp. 577-582, vol. 43.
R Core Team, "R: A Language and Environment for Statistical Computing," R Foundation for Statistical Computing, Vienna, Austria, May 2013, ISBN: 3-900051-07-0. Available online at http://www.R-25project.org/, 3604 Pages.
Rae, R., et al., "A subset of naturally isolated Bacillus strains show extreme virulence to the free-living nematodes *Caenorhabditis elegans* and *Pristionchus pacificus*", Environmental Microbiology, vol. 12, No. 11, 2010, pp. 3007-3021.
Rasmussen, S., et al., "Grass-endophyte interactions: a note on the role of monosaccharide transport in the Neotyphodium lolii-Lolium perenne symbiosis," New Phytologist, 2012, pp. 7-12, vol. 196.
Ravel, C., et al., "Beneficial effects of Neotyphodium lolii on the growth and the water status in perennial ryegrass cultivated under nitrogen deficiency or drought stress," Agronomie, 1997, pp. 173-181, vol. 17.
Reiter, B., et al., "Response of Endophytic Bacterial Communities in Potato Plants to Infection with *Erwinia carotovora* subsp. *atroseptica*," Appl Environ Microbiol., 2001, pp. 2261-2268, vol. 68, No. 5.
Ren, Y., et al., "Complete Genome Sequence of *Enterobacter cloacae* subsp. *cloacae* Type Strain ATCC 13047," J. Bacteriol. May 2010, vol. 192, No. 9, pp. 2463-2464.
Riess, K., et al., "High genetic diversity at the regional scale and possible speciation in Sebacina epigaea and S. incrustans," BMC Evolutionary Biology, 2013, vol. 13, No. 102, 17 Pages.
Riken, GI No. GMFL01-01-D03, 2 Pages, [online] [Retrieved on Dec. 18, 2017] Retrieved from the internet <URL:http://spectra.psc.riken.jp/menta.cgi/rsoy/datail?id=GMFL01-01-D03>.
Rodriguez, H., et al., "Expression of a Mineral Phosphate Solubilizing Gene From Erwinia herbicola in Two Rhizobacterial Strains," J Biotechnol., 2001, pp. 155-161, vol. 84.
Rodriguez, R.J., et al., "Stress Tolerance in Plants via Habitat-Adapted Symbiosis," ISME J., 2008, pp. 404-416, vol. 2.
Rodriguez-Navarro, D., et al., "Soybean Interactions with Soil Microbes, Agronomical and Molecular Aspects," Agronomy for Sustainable Development, 2011, pp. 173-190, vol. 31, No. 1.
Roessner, U., et al., "Metabolic Profiling Allows Comprehensive Phenotyping of Genetically or Environmentally Modified Plant Systems," Plant Cell, 2001, pp. 11-29, vol. 13.
Rosado, A. S., et al., "Phenotypic and Genetic Diversity of Paenibacillus azotofixans Strains Isolated from the Rhizoplane or Rhizosphere Soil of Different Grasses," J App Microbiol., 1998, pp. 216-226, vol. 84.
Rosenblueth, A., et al., "Seed Bacterial Endophytes: Common Genera, Seed-to-Seed Variability and Their Possible Role in Plants," Acta Hort., 2012, pp. 39-48, vol. 938.
Rosenblueth, M., et al., "Bacterial Endophytes and Their Interactions With Host," Molecular Plant-Microbe Interactions, 2006, pp. 827-837, vol. 19, No. 8.
Ross, P.L., et al., "Multiplexed Protein Quantitation in *Saccharomyces cerevisiae* Using Amine—Reactive Isobaric Tagging Reagents," Mol Cell Proteomics, 2004, pp. 1154-1169, vol. 3, No. 12.
Saleem, M., et al., "Perspective of Plant Growth Promoting Rhizobacteria (PGPR) Containing ACC Deaminase in Stress Agriculture," J Ind Microbiol Biotechnol., Oct. 2007, pp. 635-648, vol. 34.
Samac, D.A., et al., "Recent Advances in Legume-Microbe Interactions: Recognition, Defense Response, and Symbiosis from a Genomic Perspective," Plant Physiol., 2007, pp. 582-587, vol. 144.
Samways, M.J., et al., "Assessment of the Fungus *Cladosporium oxyspoum* (Berk. And Curt.) As a Potential BioControl Agent Against Certain Homoptera," Elsevier Science Publishers B.V., Jan. 1, 1986, pp. 231-239.
Sardi, P , et al., "Isolation of Endophytic Streptomyces Strains from Surface Sterilized Roots," Applied and Environmental Microbiology, 1992, pp. 2691-2693, vol. 58, No. 8.
Sarkar, S., et al., "New report of additional enterobacterial species causing wilt in West Bengal, India," Canadian Journal of Microbiology, 2015, vol. 61, No. 7, pp. 477-486.
Sarwar, M., et al., "Tryptophan Dependent Biosynthesis of Auxins in Soil," Plant Soil, 1992, pp. 207-215, vol. 147.
Saunders, M., et al., "Host-Synthesized Secondary Compounds Influence the In Vitro Interactions between Fungal Endophytes of Maize", Applied and Environmental Microbiology, Nov. 9, 2007, pp. 136-142, vol. 74, No. 1.
Schmieder, R., et al., "Quality Control and Preprocessing of Metagenomic Datasets," Bioinformatics, 2011, pp. 863-864, vol. 27, No. 6.

(56) References Cited

OTHER PUBLICATIONS

Schneider, C., et al., "Endophytes for plant protection: the state of the art Proceedings," DPG Spectrum Phytomedizin, Proceedings of the 5th International Symposium on Plant Protection and Plant Health in Europe, May 26-29, 2013, 347 Pages.

Schoch, C. L., et al., "Nuclear Ribosomal Internal Transcribed Spacer (ITS) Region as a Universal DNA Barcode Marker for Fungi," Proc Natl Acad Sci USA, 2012, pp. 6241-6246, vol. 109, No. 16.

Schwyn, B. et al., "Universal Chemical Assay for the Detection and Determination of Siderophores," Analytical Biochemistry, 1987, pp. 47-56, vol. 160.

NCBI, GenBankAccession No. KX641980.1, Jul. 29, 2017, Scott, M., et al., "*Dothideomycetes* sp. isolate FT14-6 Internal transcribed spacer 1, partial sequence; 5.8S ribosomal RNA gene and internal transcribed spacer 2, complete sequence; and large subunit ribosomal RNA gene, partial sequence," 2 Pages, Can be retrieved at<URL:https://www.ncbi.nlm.nih.gov/nuccore/KX641980>.

Senthilkumar, M., et al., "Biocontrol Potential of Soybean Bacterial Endophytes Against Charcoal Rot Fungus, *Rhizoctonia bataticola*," Current Microbiology, 2009, vol. 58, pp. 288-293.

"Sequence Alignment of JQ047949 with Instant SEQ ID No. 2," Search conducted on Jan. 2, 2019, 2 pages.

Sessitsch, A., et al., "*Burkholderia phytofirmans* sp. Nov., a novel plant-associated bacterium with plant-beneficial properties," International Journal of Systematic and Evoluntary Microbiology, 2005, pp. 1187-1192, vol. 55.

PCT Invitation to Pay Additional Fees, PCT Application No. PCT/US2015/068206, Apr. 12, 2016, 5 Pages.

PCT International Search Report and Written Opinion, PCT Application No. PCT/US2015/068206, Jun. 27, 2016, 20 Pages.

PCT International Search Report and Written Opinion, PCT Application No. PCT/US2016/030292, Aug. 12, 2016, 20 Pages.

PCT International Preliminary Report on Patentability, PCT Application No. PCT/US2016/030292, Aug. 2, 2017, 23 Pages.

PCT International Search Report and Written Opinion, PCT Application No. PCT/US2016/030293, Aug. 11, 2016, 23 Pages.

PCT International Search Report and Written Opinion, PCT Application No. PCT/US2016/036504, Nov. 4, 2016, 18 Pages.

PCT International Search Report and Written Opinion, PCT Application No. PCT/US2016/039191, Nov. 29, 2016, 20 Pages.

PCT International Search Report and Written Opinion, PCT Application No. PCT/US2016/068144, May 18, 2017, 30 Pages.

Djordjevic, D., et al., "Microtiter Plate Assay for Assessment of Listeria monocytogenes Biofilm Formation," Annl Environ Microbiol., 2002, pp. 2950-2958, vol. 68, No. 6.

European Patent Office, Supplementary Partial European Search Report, European Patent Application No. 13874703.5, Jun. 21, 2016, 3 Pages.

European Patent Office, Supplementary European Search Report, European Patent Application No. 13874703.5, Oct. 21, 2016, 16 Pages.

European Patent Office, Communication Pursuant to Article 94(3) EPC for European Patent Application No. 13874703.5, Jan. 5, 2018, 4 Pages.

European Patent Office, Supplementary European Search Report, European Patent Application No. 14860187.5, May 24, 2017, 9 Pages.

European Patent Office, Supplementary European Search Report, European Patent Application No. 14874589.6, dated Jul. 11, 2017, 9 Pages.

European Patent Office, Communication Pursuant to Article 94(3) EPC for European Patent Application No. EP 14748326.7, Feb. 15, 2018, 7 Pages.

European Patent Office, Examination Report, European Patent Application No. 14748326.7, dated Jul. 19, 2017, 4 Pages.

European Patent Office, Examination Report for European Patent Application No. EP 14777213.1, Oct. 20, 2017, 12 Pages.

European Patent Office, Supplementary European Search Report, European Patent Application No. EP 15809264.3, Dec. 4, 2017, 16 Pages.

European Patent Office, Communication Pursuant to Article 94(3) EPC for European Patent Application No. 15810847.2, Nov. 17, 2017, 17 Pages.

European Patent Office, Supplementary European Search Report, European Patent Application No. EP 15812324.0, Nov. 2, 2017, 19 Pages.

Dunbar, J, et al., "Uncultured Bacterium Clone NT42a2_20488 16S Ribosomal RNA Gene, Partial Sequence," NCBI GenBank Accession No. JQ378705. Submitted Nov. 8, 2012, 2 Pages.

Jalgaonwala, R., et al., "A Review on Microbiol Endophytes from Plants: A Treasure Search for Biologically Active Metabolites," Global Journal of Research on Medicinal Plants & Indigenous Medicine, 2014, pp. 263-277, vol. 3, No. 6.

Phalip, V., et al., "A Method for Screening Diacetyl and Acetoin-Producing Bacteria on Agar Plates," J Basic Microbiol., 1994, pp. 277-280, vol. 34.

Sword, G., et al., "Manipulating Fungal Endophytes for the Protection of Cotton in the Field," Power Point Presentation dated Jan. 7, 2013.

Theis, K. R., et al., "Uncultured Bacterium Clone GM2GI8201A64RC 16S Ribosomal RNA Gene, Partial Sequence," NCBI GenBank Accession No. JX051943, Submitted May 14, 2012, 1 Page.

Trichoderma definition, 2016, 6 Pages, [online] [Retrieved on Sep. 16, 2016,] Retrieved from the Internet <URL: https://en.wikipedia.org/wiki/Trichoderma>.

Wiegand, I., et al., "Agar and Broth Dilution Methods to Determine the Minimal Inhibitory Concentration (MIC) of AntiMicrobial Substances," Nature Protocols, 2008, pp. 163-175, vol. 3, No. 2.

PCT International Search Report and Written Opinion, PCT Application No. PCT/US2015/038110, Dec. 11, 2015, 36 Pages.

Langille, M.G.I. et al., "Predictive functional profiling of microbial communities using 16S rRNA marker, gene sequences," Nature Biotechnology, 2013, vol. 31, No. 9, pp. 814-821.

PCT Invitation to Pay Additional Fees, PCT Application No. PCT/US2017/064351, Feb. 9, 2018, 18 Pages.

PCT International Search Report and Written Opinion, PCT Application No. PCT/US2017/064351, Apr. 9, 2018, 25 Pages.

PCT Invitation to Pay Additional Fees, PCT Application No. PCT/US2017/064361, Mar. 7, 2018, 18 Pages.

European Patent Office, Supplementary European Search Report for European Patent Application No. 15810847.2, Feb. 28, 2018, 19 Pages.

European Patent Office, Extended European Search Report, European Patent Application No. EP 15812324.0, Feb. 21, 2018, 23 Pages.

European Patent Office, Extended European Search Report, European Patent Application No. EP 15809264.3, Mar. 12, 2018, 14 Pages.

PCT International Search Report and Written Opinion for PCT/US2017/064361, May 11, 2018, 22 Pages.

PCT International Search Report and Written Opinion, PCT Application No. PCT/US2017/064292, May 11, 2018, 20 Pages.

European Patent Office, Extended European Search Report, European Patent Application No. EP 15876324.3, Jun. 12, 2018, 9 Pages.

Redman, R. S., et al., "Thermotolerance Generated by Plant/Fungal Symbiosis," Science, Nov. 2002, vol. 298, 1 Page (with 4 pages of supplemental material).

You, Y., et al., "Analysis of Genomic Diversity of Endophytic Fungal Strains Isolated from the Roots of Suaeda japonica and S. maritima for the Restoration of Ecosystems in Buan Salt Marsh," Korean Journal of Microbiology and Biotechnology, 2012, pp. 287-295, vol. 40, No. 4. (with English Abstract).

Invitation to Pay Additional Fees, PCT Application No. PCT/CA2013/000091, Mar. 27, 2013, 2 Pages.

International Search Report and Written Opinion for PCT/EP2013/062976, Dec. 22, 2014, 9 Pages.

International Search Report and Written Opinion, Application No. PCT/US2014/054160, Dec. 9, 2014, 21 Pages.

Invitation to Pay Additional Fees, PCT Application No. PCT/US2014/064411, Feb. 5, 2015, 2 Pages.

(56) References Cited

OTHER PUBLICATIONS

International Search Report and Written Opinion, International Application No. PCT/US2014/064411, Mar. 27, 2015, 15 Pages.
International Search Report and Written Opinion, International Application No. PCT/US2014/072399, Jun. 26, 2015, 22 Pages.
Invitation to Pay Additional Fees, PCT Application No. PCT/US2014/072400, Apr. 16, 2015, 6 Pages.
International Search Report and Written Opinion, Application No. PCT/US2014/072400, Jul. 8, 2015, 38 Pages.
Abarenkov, K., et al., "PlutoF—A Web Based Workbench for Ecological and Taxonomic Research, with an Online Implementation for Fungal ITS Sequences," Evol Bioinform Online, 2010, pp. 189-196, vol. 6.
Li, Q., "Agrobacterium tumefaciens Strain TA-AT-10 16S Ribosomal RNA Gene, Partial Sequence: GenBank: KF673157.1," Submitted Dec. 16, 2013.
Lehman, S.G., "Treat Cotton Seed," Research and Farming III, Progr. Rept., 1945, 3, 5, 16 Pages.
Leonard, C. A., et al., "Random Mutagenesis of the Aspergillus oryzae Genome Results in Fungal Antibacterial Activity," Int J Microbiol., 2013, vol. 2013, Article ID 901697, 6 Pages.
Li, H. M., et al., "Expression of a Novel Chitinase by the Fungal Endophyte in Poa ampla," Mycologia, 2004, pp. 526-536, vol. 96, No. 3.
Li, H., et al., "Endophytes and their role in phytoremediation," Fungal Diversity, 2012, pp. 11-18, vol. 54.
Li, M., et al., "ATP Modulates the Growth of Specific Microbial Strains", Current Microbiology, May 30, 2010, vol. 62, No. 1, pp. 84-89.
Liu, M., et al., "A Novel Screening Method for Isolating Exopolysaccharide-Deficient Mutants," Appl Environ Microbiol., 1998, pp. 4600-4602, vol. 64, No. 11.
Liu, Y., et al., "Investigation on Diversity and Population Succession Dynamics of Endophytic Bacteria from Seeds of Maize (*Zea mays* L., Nongda108) at Different Growth Stages," Ann Microbiol., 2013, pp. 71-79, vol. 63.
Liu, D., et al., "Osmotin Overexpression in Potato Delays Development of Disease Symptoms," Proc Natl Acad Sci USA, 1994, pp. 1888-1892, vol. 91.
Liu, Y., et al., "Phylogenetic relationships among ascomycetes: evidence from an RNA polymerase II subunit," Mol. Biol. Evol. 1999. vol. 16, No. 12, pp. 1799-1808.
Liu, Y., et al., "Study on Diversity of Endophytic Bacterial Communities in Seeds of Hybrid Maize and their Parental Lines," Arch Microbiol., 2012, pp. 1001-1012, vol. 194.
Long, H. H., et al., "The Structure of the Culturable Root Bacterial Endophyte Community of Nicotiana attenuata is Organized by Soil Composition and Host Plant Ethylene Production and Perception," New Phytol., 2010, pp. 554-567, vol. 185.
Lopez-Lopez, A., et al., "Phaseolus vulgaris Seed-Borne Endophytic Community with Novel Bacterial Species such as *Rhizobium endophyticum* sp. nov.," Systematic Appl Microbiol., 2010, pp. 322-327, vol. 33.
Lorck, H., "Production of Hydrocyanic Acid by Bacteria," Physiol Plant, 1948, pp. 142-146, vol. 1.
Lugtenberg, B., et al., "Plant-Growth-Promoting Rhizobacteria," Ann. Rev. Microbiol., 2009, pp. 541-556, vol. 63.
Lundberg, D.S., et al., "Defining the Core *Arabidopsis thaliana* Root Microbiome," Nature, 2012, pp. 86-90, vol. 488, No. 7409.
Lundberg, D.S., et al., "Practical Innovations for High-Throughput Amplicon Sequencing," Nat Methods, 2013, pp. 999-1002, vol. 10, No. 10.
Ma, Y., et al., "Plant Growth Promoting Rhizobacteria and Endophytes Accelerate Phytoremediation of Metalliferous Soils," Biotechnology Advances, 2011, pp. 248-258, vol. 29.
Madi, L. et al., "Aggregation in Azospirillum brasilense Cd: Conditions and Factors Involved in Cell-to-Cell Adhesion," Plant Soil, 1989, pp. 89-98, vol. 115.

Mandyam, K., et al., "Mutualism-parasitism paradigm synthesized from results of root-endophyte models", Frontiers in Microbiology, vol. 5, Jan. 12, 2015, pp. 1-14.
Mannisto, M.K., et al., "Characterization of Psychrotolerant Heterotrophic Bacteria From Finnish Lapland," Syst Appl Microbiol., 2006, pp. 229-243, vol. 29.
Mano, H., et al., "Culturable Surface and Endophytic Bacterial Flora of the Maturing Seeds of Rice Plants (*Oryza saliva*) Cultivated in a Paddy Field," Microbes Environ., 2006, vol. 21, No. 2.
Manoharan, M. J. et al., "Survival of flocculated cells in alginate and its inoculatin effect on growth and yield of maize under water deficit conditions," EP J of Soil Biology, Gauthier-Villars, Montrouge, FR, vol. 50, Mar. 7, 2012, pp. 198-206, XP028421147.
Manter, D. K., et al., "Use of the ITS Primers, ITSIF and ITS4, to Characterize Fungal Abundance and Diversity in Mixed-Template Samples by qPCR and Length Heterogeneity Analysis," J Microbiol Methods, 2007, pp. 7-14, vol. 71.
Mao, W., et al., "Seed Treatment with a Fungal or a Bacterial Antagonist for Reducing Corn Damping-off Caused by Species of Pythium and Fusarium," Plant Disease, 1997, pp. 450-454, vol. 81, No. 5.
Marasco, R., et al., "A Drought Resistance-Promoting Microbiome is Selected by Root System Under Desert Farming," PLoS ONE, 2012, vol. 7, No. 10, 14 Pages.
Marquez, L. M., et al., "A Virus in a Fungus in a Plant: Three-Way Symbiosis Required for Thermal Tolerance," Science, 2007, pp. 513-515, vol. 315.
Mastretta, C., et al., "Endophytic Bacteria from Seeds of Nicotiana Tabacum Can Reduce Cadmium Phytotoxicity," Intl J Phytoremediation, 2009, pp. 251-267, vol. 11.
Mateos, P. F., et al., "Cell-Associated Pectinolytic and Cellulolytic Enzymes in Rhizobium leguminosarum biovartrifolii," Appl Environ Microbiol., 1992, pp. 816-1822, vol. 58, No. 6.
Mcdonald, D., et al., "An Improved Greengenes Taxonomy with Explicit Ranks for Ecological and Evolutionary Analyses of Bacteria and Archaea," ISME J., 2012, pp. 610-618, vol. 6.
Mcguire, K.L., et al., "Digging the New York City Skyline: Soil Fungal Communities in Green Roofs and City Parks," PloS One, 2013, vol. 8, No. 3, 13 Pages.
Medina, P., et al., "Rapid Identification of Gelatin and Casein Hydrolysis Using TCA," J Microbiol Methods, 2007, pp. 391-393, vol. 69.
Mehnaz, S., et al., "Growth Promoting Effects of Corn (*Zea mays*) Bacterial Isolates Under Greenhouse and Field Conditions," Soil Biology and Biochemistry, 2010, pp. 1848-1856, vol. 42.
Mehnaz, S., et al., "Isolation and 16S rRNA sequence analysis of the beneficial bacteria from the rhizosphere of rice," Canada Journal of Microbiology, 2001, pp. 110-117, vol. 47, No. 2.
Mei, C., et al., "The Use of Beneficial Microbial Endophytes for Plant Biomass and Stress Tolerance Improvement," Recent Patents on Biotechnology, 2010, pp. 81-95, vol. 4.
Michel, B. E., et al., "The Osmotic Potential of Polyethylene Glycol 6000," Plant Physiol., 1973, pp. 914-916, vol. 51.
Misk, A., et al., "Biocontrol of chickpea root rot using endophytic actinobacteria", Biocontrol, vol. 56, No. 5, Mar. 12, 2011, pp. 811-822, XP036215297.
Miyoshi-Akiyama, T., et al., "Multilocus Sequence Typing (MLST) for Characterization of Enterobacter cloacae," PLoS ONE, 2013, vol. 8, No. 6, 10 Pages, e66358.
Moe, L. A., "Amino Acids in the Rhizosphere: From Plants to Microbes," American Journal of Botany, 2013, pp. 1692-1705, vol. 100, No. 9.
Mohiddin, F. A., et al., "Tolerance of Fungal and Bacterial Biocontrol Agents to Six Pesticides Commonly Used in the Control of Soil Borne Plant Pathogens," African Journal of Agricultural Research, 2013, pp. 5331-5334, vol. 8, No. 43.
Mousa, W. K., et al., "The Diversity of Anti-Microbial Secondary Metabolites Produced by Fungal Endophytes: An Interdisciplinary Perspective," Front Microbiol., 2013, vol. 4, No. 65, 18 Pages.
Mundt, J.O., et al., "Bacteria Within Ovules and Seeds," Appl Environ Microbiol., 1976, pp. 694-698, vol. 32, No. 5.

(56) References Cited

OTHER PUBLICATIONS

Naik, B. S., et al., "Study on the diversity of endophytic communities from rice (*Oryza sativa* L.) and their antagonistic activities in vitro," Microbiological Research, 2009, pp. 290-296, vol. 164.
Nassar, A., et al., "Promotion of plant growth by an auxin-producing isolate of the yeast *Williopsis saturnus* endophytic in maize (*Zea mays* L.) roots", Biology and Fertility of Soils; Cooperating Journal of International Society of Soil Science, Springer, Berlin, DE, vol. 42, No. 2, Nov. 1, 2005, pp. 97-108.
Naveed, M., "Maize Endophytes—Diversity, Functionality and Application Potential," University of Natural Resources and Life Sciences, 2013, pp. 1-266 and 81-87; Tables 1-3; Figure 2.
Nejad, P. et al., "Endophytic Bacteria Induce Growth Promotion and Wilt Disease Suppression in Oilseed Rape and Tomato," Biological Control, 2000, pp. 208-215, vol. 18.
Neslon, E.B., "Microbial Dynamics and Interactions in the Spermosphere," Ann. Rev. Phytopathol., 2004, pp. 271-309, vol. 42.
Nikolcheva, L.G., et al., "Taxon-Specific Fungal Primers Reveal Unexpectedly High Diversity During Leaf Decomposition in a Stream," Mycological Progress, 2004, pp. 41-49, vol. 3, No. 1.
Murali, Gopal, et al., "Microbiome Selection Could Spur Next-Generation Plant Breeding Strategies," Frontiers in Microbiology, vol. 7, Dec. 7, 2016, XP055531064.
Nimnoi, P., et al., "Co-Inoculation of Soybean (*Glycin max*) wtth Actinomycetes and Bradyrhizobium Japonicum Enhances Plant Growth, Nitrogenase Activity and Plant Nutrition," Journal of Plant Nutrition, 2014, pp. 432-446, vol. 37.
Nishijima, K.A., et al., "Demonstrating Pathogenicity of Enterobacter cloacae on Macadamia and Identifying Associated Volatiles of Gray Kernel of Macadamia in Hawaii," Plant Disease, Oct. 2007, vol. 91, No. 10, pp. 1221-1228.
Invitation to Pay Additional Fees, PCT Application No. PCT/US2015/038110, Sep. 22, 2015, 8 Pages.
NCBI GenBank: Accession No. XP55670271, "*Enterobacter* sp. MLB05 16S ribosomal RNA gene, partial sequence—Nucleotide", Jun. 9, 2012, 1 Page, can be retreived at URL:https://www.ncbi.nlm.nih.gov/nuccore/J Q765415.1/.
NCBI GenBank: Accession No. XP55670274, "*Enterobacter* sp. CR 6-3 16S ribosomal RNA gene, partial sequence—Nucleotide", Mar. 27, 2013, 1 Page, can be retreived at URL:https://www.ncbi.nlm.nih.gov/nuccore/K C355340.
NCBI GenBank: Accession No. XP55670279, "Uncultured bacterium clone bb2s4 16S ribosomal RNA gene, partial seque—Nucleotide", May 6, 2005, 1 Page, can be retreived at URL:https://www.ncbi.nlm.nih.gov/nuccore/D Q068880.
European Patent Office, Communication Pursuant to Article 94(3) EPC for European Patent Application No. EP 14777213.1, Jun. 18, 2018, 4 Pages.
De Melo Pereira, G. V., et al. "A Multiphasic Approach for the Identification of Endophytic Bacterial in Strawberry Fruit and their Potential for Plant Growth Promotion," Microb. Ecology, 2012, pp. 405-417, vol. 63, No. 2.
Result 11 from a search in the GenEmbl database, GenEmbl Record No. EU 977189, Smith et al., "Bioactive endophytes warrant intensified exploration and conservation," PLoS ONE 3(8):E3052, 2008.
Result 3 from a search in the GenEmbl database, GenEmbl Record No. KF011597, Paenibacillus strain No. HA13, Park et al., "Isolation and characterization of humic substances-degrading bacteria from the subarctic Alaska grasslands," J Basic Microbiol, 2013.
PCT International Search Report and Written Opinion for PCT/US2018/051467, Feb. 4, 2019, 22 pages.
Chaves, J., et al., "Identification and Phylogeny of Streptomyces Based on Gene Sequences", Research Journal of Microbiology, vol. 13, No. 1, Dec. 15, 2017, pp. 13-20, XP055675917.
Girard, G., et al., "A novel taxonomic marker that discriminates between morphologically complex actinomycetes", Open Biology, vol. 3, No. 10, Oct. 2013, p. 130073,XP055675916.
Guo, Y., et al. "A multi locus phylogeny of the Streptomyces griseus 16S rRNA gene clade: use of multilocus sequence analysis for streptomycete systematics", International Journal of Systematic and Evolutionary Microbiology, vol. 58, No. 1, 2008, pp. 149-159, XP055675936.
PCT Invitation to Pay Additional Fees, PCT Application No. PCT/US2017/064292, Mar. 6, 2018, 15 Pages.
PCT International Search Report and Written Opinion, PCT Application No. PCT/US2017/068255, Mar. 19, 2018, 14 Pages.
PCT International Search Report and Written Opinion PCT/AU2018/050387, Jul. 12, 2018 (Filing date is Apr. 27, 2018).
PCT International Search Report and Written Opinion for PCT/US2017/064292, May 11, 2018, 20 Pages.
Bentley, S.D., et al., Complete genome sequence of the model actinomycete Streptomyces coelicolor A3(2), Nature. May 9, 2002;417(6885):141-7. (Year: 2002).
Gabor, J., et al., "Mycorrhizal fungi effects on nutrient composition and yield of soybean seeds," Journal of Plant Nutrition, 20:4-5, 581-591, 1997.
Gopalakrishnan, S. et al., "Plant growth-promoting activities of *Streptomyces* spp. In sorghum and rice", SpringerPlus, 2/1/574, pp. 1-8, http://www.springerplus.com/content/2/1/574, 2013.
Groppe, K., et al., "Interaction between the endophytic fungus *Epichloë bromicola* and the grass *Bromus erectus*: effects of endophyte infection, fungal concentration and environment on grass growth and flowering," Mol Ecol., 8:1827-1835, 1999.
Hubbard, M., "Fungal Endophytes that Confer Heat and Drought Tolerance to Wheat," Doctoral dissertation, University of Saskatchewan, 2012.
Ikeda, H., et al., "Complete genome sequence and comparative analysis of the industrial microorganism Streptomyces avermitilis," Nat Biotechnol. May 2003;21 (5) :526-31. Epub Apr. 14, 2003. (Year: 2003).
Lee, J., et al., "*Streptomyces koyangensis* sp. nov., a novel actinomycete that produces 4-phenyl-3-butenoic acid," Int J Syst Evol Microbial. Jan. 2005;55(Pt 1):257-62. (Year: 2005).
Lind, A., et al., "Drivers of genetic diversity in secondary metabolic gene clusters within a fungal species", PLOS Biology, Nov. 17, 2017, 26 pages.
Pacovsky, R., "Carbohydrate, protein and amino acid status of Glycine-Glomus-Bradyrhizobium symbioses," Physiologia Pantarium; 75:346-354, 1989).
Sha, T. et al., "Genetic diversity of the endemic gourmet mushroom *Thelephora ganbajun* from southwestern China", Microbiology (2008), 154, 3460-3468.
Sugita, T. et al., "Intraspecies Diversity of Cryptococcus laurentii as Revealed by Sequences of Internal Transcribed Spacer Regions and 28S rRNA Gene and Taxonomic Position of C. laurentii Clinical Isolates", Journal of Clinical Microbiology, Apr. 2000, p. 1468-1471.
Wiebold, M., et al., "Agriculture Experiment Station, College of Agriculture, Food & Natural Resources, University of Missouri, Special Report 589, pp. 1-124)."
Le, X.H., et al., "Effects of endophytic Streptomyces on the lucerne (*Medicago sativa* L.) symbiosis at different levels of nitrogen," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 66-67.
Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
European Patent Office, Supplementary European Search Report, European Patent Application No. 13874703.5, Jun. 21, 2016, 3 Pages.
Invitation to Pay Additional Fees, PCT Application No. PCT/US2015/038187, Oct. 14, 2015, 5 Pages.
Coombs, J. T., et al., "Isolation and Identification of Actinobacteria from Surface-Sterilized Wheat Roots," Applied and Environmental Microbiology,, 2003, pp. 5603-5608, vol. 69, No. 9.
Laus, M. C., et al., "Role of Cellulose Fibrils and Exopolysaccharides of Rhizobium leguminosarum in Attachment to and Infection of Vicia sativa Root Hairs," Mol Plant Microbe Internet., 2005, pp. 533-538, vol. 16, No. 6.
PCT International Search Report and Wlitten Opinion, PCT Application No. PCT/US2015/068206, Jun. 27, 2016, 20 Pages.

(56) References Cited

OTHER PUBLICATIONS

PCT International Search Report and Wlitten Opinion, PCT Application No. PCT/US2016/036504, Nov. 4, 2016, 18 Pages.
GenEmbl Database, GenEmbl Record No. JN872548.1, 2 Pages.
Soe, K.M, et al, "Evaluation of effective Myanmar Bradyrhizobium strains isolated from Myanmar soybean and effects of coinoculation with Streptomyces griseoglavus P4 for nitrogen fixation", Soil science and plant nutrition 59.3 (2013): 361-370 (Year: 2013).
Ngom, A et al., "A novel symbiotic nitrogen-fixing member of the Ochrobactrum clade isolated from root nodues of Acacia mangium". J. Gen. Appl. Microbiol. (2004) 50: 17-27.
Trujillo, M.E et al., "Nodulation of Lupinus albus by strins of *Ochrobactrum lupini* sp. nov." Appl. Environ Microbiol Mar. 2005; 71(3): 1318-1327.
Bal, H.B et al., "Isolation of ACC deaminase producting PGPR from rice rhizosphere and evaluating their plant growth promoting activity under salt stress". Plant Soil (2013) 366: 93-105 doi: 10/1007/s11104-012-1402-5.
Chakraborty et al., "Evaluation of Ochrobactrum anthropi TRS-2 and its talcbased formulation for enhancement of growth of tea plants and management of brown root rot disease." Journal of Applied Microbiology, 2009, 107(2):625-634 DOI:10.1111/j.1365-2672.2009.04242.x <https://doi.org/10.1111/j.1365-2672.2009.04242.x.
Sulistiyani, et al., "Population and Diversity of Endophytic Bacteria Associated with Medicinal Plan Curumma zedoaria ", Microbiology Indonesia 8.2 (2014):4.
Bevivino, A., et al., "Characerization of free-living maize rhizosphere populatin of Burkholderia cepacia: effect of seed treatment on disease suppresssion and growth promotion of maize", FEMS Microbiology Ecology 27 (1998) 225-237.
Ciccillo, F., et al., Effects of two different application methods of Burkholderia ambifaria MCI 7 on plant growth and rhizospheric bacterial diversity.
Estrada, P., et al., "A N2-fixing endophytic *Burkholderia* sp. associated with maize plants culitvated in Mexico", Canadian Journal of Microbiology (2002), vol. 48(4), pp. 528-536.
Sharma, V.K., et al., "Enhancement of verticillium wilt resistance in tomato transplants by in vitro co-culture of seedlings with a plant growth promoting rhizobacterium (*Pseudomonas* sp. strain PsJN)", Canadian Journal of Microbiology (1998), vol. 44(6), pp. 285-294.
Grady, E., et al., "Current knowledge and perspectives of Paenibacillus: a review" Microb Cell Fact (2016) 15:203.
Hamayun, M., et al., "Gibberellin production and plant growth promotion from pure cultures of *Cladosporium* sp. MH-6 isolated from cucumber (*Cucumis sativus* L.)", Mycologia, 102 (5), 2010, pp. 989-995.
Shupeng, T., et al. "Advances in Study of Interactions between Mycorrhizal Fungi and Bacteria", Journal of Qingdao Agricultural University (Natural Science Edition), vol. 30, Issue 4, pp. 240-246, Dec. 31, 2013.
Kim, S., et al., "Physiological and proteomic analyses of Korean F1 maize (*Zea mays* L.) hybrids under water-deficit stress during flowering", Appl. Biol. Chem. (2019) 62:32.
Halligan, B., et al., "Cloning of the murine cDNA encoding VDJP, a protein homologous to the large subunit of replication factor C and bacterial DNA ligases", Gene (1995) 217-222.
Arend, J., et al., "Hydroquinone: O-glucosytransferase from cultivated Rauvolfia cells: enrichment and partial amino acid sequences", Phytochemistry (2000) 53:187-193.
Enchev, R., et al., "Protein neddylation: beyond cullin-RING ligases", (Nature Reviews: Molecular Cell Biology (2015) 16:30-44.
Bais, H., et al., "The Role of Root Exudates in Rhizophere Interactions with Plants and Other Organisms", Annual Review. Plant Biol. (2006) 57:233-266.
Goepfert, S., et al., "Molecular Identification and Characterization of the *Arabidopsis* D3,5, D2,4-Dienoyl-Coenzyme A Isomerase, a Peroxisomal Enzyme Participating in the b-Oxidation Cycle of Unsaturated Fatty Acids1", Plant Physiology (2005) 138:1947-1956.

Thomas, P., et al: "Endophytic Bacteria Associated with Growing Shoot Tips of Banana (*Musa* sp.) cv. Grand Naine and the Affinity of Endophytes to the Host", Microbial Ecology, Springer-Verlag, NE, vol. 58, No. 4, Jul. 25, 2009 (Jul. 25, 2009), pp. 952-964, XP019757395, ISSN: 1432-184X, DOI: 10.1007 /S00248-009-9559-Z.
Database Geneseq [Online] Sep. 30, 2010 (Sep. 30, 2010), "Cellulomonas fermentans 16s rRNA gene SEQ ID:39.", retrieved from EBI accession No. GSN:AWL84299 Database accession No. AWL84299; & JP 2009 072168 A (Univ of Occupational & Environ) Apr. 9, 2009 (Apr. 9, 2009).
European Patent Office, Partial European Search Report, European Patent Application No. 20171870.7, Nov. 20, 2020, 18 Pages.
Li, J., et al., "Antitumour and antimicrobial activities of endophytic stretomycetes from pharmaceutical plants in rainforest", Lett Appl Microbiol. Dec. 2008; 47(6): 574-80. (Year: 2008).
Fiehn, O., et al., "Metabolite Profiling for Plant Functional Genomics," Nature Biotechnol., 2000, pp. 1157-1161, vol. 8.
Fierer, N., et al., "Cross-Biome Metagenomic Analyses of Soil Microbiol Communities and Their Functional Attributes," Proc Natl Acad Sci USA, 2012, pp. 21390-21395, vol. 109, No. 52.
Fincher, G. B., "Molecular and Cellular Biology Associated with Endosperm Mobilization in Germinating Cereal Grains," Annu Rev Plant Physiol Plant Mol Biol., 1989, pp. 305-346, vol. 40.
Fisher, P. J., et al., "Fungal saprobes and pathogens as endophytes of rice (*Oryza sativa* L.)," New Phytol., 1992, pp. 137-143, vol. 120.
Fisher, P.R., et al., "Isolation and Characterization of the Pesticide-Degrading Plasmid pJP1 from Alcaligenes paradoxus," J Bacteriol., 1978, pp. 798-804, vol. 135, No. 3.
Fox, G., et al., "How close is close: 16S rRNA sequence identity may not be sufficient to guarantee species identity." International Journal of Systematic and Evolutionary Microbiology 42.1, 1992, pp. 166-170.
Franco, C., et al., "Actinobacterial Endophytes for Improved Crop Performance," Australasian Plant Pathology, 2007, pp. 524-531, vol. 36.
Fulthorpe, R. R., et al., "Distantly Sampled Soils Carry Few Species in Common," ISME J., 2008, pp. 901-910, vol. 2.
Gantner, S., et al., "Novel Primers for 16S rRNA-based Archaeal Community Analyses in Environmental Samples," J Microbiol Methods, 2011, pp. 12-18, vol. 84.
Gao, Z., et al., "Quantitation of Major Human Cutaneous Bacterial and Fungal Populations," J Clin Microbiol., 2010, pp. 3575-3581, vol. 48, No. 10.
Garazzino, S., et al., "Osteomyelitis Caused by Enterobacter cancerogenus Infection following a Traumatic Injury: Case Report and Review of the Literature," J Clin Microbiol., Mar. 2005, vol. 43, No. 3, pp. 1459-1461.
Gasser, I., et al., "Ecology and Characterization of Polyhydroxyalkanoate-Producing Microorganisms on and in Plants," FEMS Microbiol Ecol., 2010, pp. 142-150, vol. 70.
Gavrish, E, et al., "*Lentzea* sp. MS6 16S Ribosomal RNA Gene, Partial Sequence," NCBI GenBank Accession No. EF599958. Submitted May 9, 2007, 1 Page.
Gebhardt, J., et al., "Characterization of a single soybean cDNA encoding cytosolic and glyoxysomal isozymes of aspartate aminostransferase," Plant Molecular Biology, 1998, pp. 99-108, vol. 37.
GenBank: AF034210.1 "Glycine max aspartate aminotransferase glyoxysomal isozyme AAT1 precursor and aspartate aminotransferase cytosolic isozyme AAT2 (AAT) mRNA, complete eds," NCBI, May 26, 1998, 2 Pages, can be retrieved at <URL:https://www.ncbi.nlm.nih.gov/nuccore/AF034210>.
GenBank: JN210900.1, "*Enterobacter* sp. WS05 16S ribosomal RNA gene, partial sequence," NCBI, Sep. 24, 2012, 1 Page, can be retrieved at <URL:https://www.ncbi.nlm.nih.gov/nuccore/jn210900>.
GenBank: NP_001237541.1, "aspartate aminotransferase glyoxysomal isozyme AAT1 precursor [Glycine max]," NCBI, Oct. 29, 2016, 2 Pages, can be retrieved at <URL:https://www.ncbi.nlm.nih.gov/protein/NP_001237541.1 >.

(56) References Cited

OTHER PUBLICATIONS

NCBI GenBank: CP000653.1 "*Enterobacter* sp. 638, complete genome" Jan. 28, 2014, 5 Pages, Can be retrieved at<URL:https://www.ncbi.nlm.nih.gov/nuccore/CP000653.1>.
NCBI GenBank: CP000653.1 "*Enterobacter* sp. 638, complete genome" ASM1632v1, Apr. 18, 2007, 2 Pages, Can be retrieved at <URL:https://www.ncbi.nlm.nih.gov/assembly/GCA000016325.1 >.
NCBI GenBank: EU340965.1 "*Enterobacter* sp. 638 16S ribosomal RNA gene, partial sequence" Jan. 30, 2009, 1 Page, Can be retrieved at <URL:https://www.ncbi.nlm.nih.gov/nuccore/EU340965.1>.
NCBI GenBank: EBI accession No. EM STD:JQ759988, "*Dothideomycetes* sp. genotype 226 isolate FL0175 internal transcribed spacer 1, partial sequence; 5.8S ribosomal RNA gene and internal transcribed spacer 2, complete sequence; and 28S ribosomal RNA gene, partial sequence," May 17, 2012, 2 Pages.
NCBI GenBank: EBI accession No. EM STD:GU055658, "Uncultured Periconia clone NG R 806 18S ribosomal RNA gene, partial sequence; internal transcribed spacer 1, 5.8S ribosomal RNA gene, and internal transcribed spacer 2, complete sequence; and 28S ribosomal RNA gene, partial sequence," Oct. 27, 2009, 2 Pages.
NCBI GenBank: Accession No. JX880250.1, "Enterobacteriaceae bacterium Clero1 16S ribosomal RNA gene, partial sequence," NIH, Jun. 24, 2015, 2 Pages, can be retrieved at <URL:https://www.ncbi.nlm.nih.gov/nucleotidelJX880250.1?report=genbank&log$=nuclalign&blast_rank=80 &RID=KWUPBV08015>.
GenBank Accession No. KY643705, Feb. 27, 2017.
GenBank Accession No. KF951483, Jan. 5, 2014.
GenBank Accession No. KJ152029, May 6, 2015.
GenBank Accession No. KJ162248, Apr. 8, 2014.
GenEmbl Database, GenEmbl Record No. KF673660, Sandberg, et al., "Fungal endophytes of aquatic macrophytes: diverse host-generalists characterized by tissue preferences and geographic structure," 2013, 35 Pages.
GenEmbl Database, GenEmbl Record No. KP991588, Huang, et al., "Pervasive effects of wildfire on foliar endophyte communities in montane forest trees," Mar. 2015, 35 Pages.
GenEmbl database, GenEmbl Record No. EU 977189, Jan. 21, 2009, 4 pages, Smith, S.A., et al., "Bioactive endophytes warrant intensified exploration and conservation," PloS ONE 3(8):E3052, 2008.
GenEmbl database, GenEmbl Record No. KF011597, Paenibacillus strain No. HA 13, Aug. 26, 2013, 5 Pages, Park, H.J., et al., "Isolation and characterization of humic substances-degrading bacteria from the subarctic Alaska grasslands," J Basic Microbiol, 2013.
Database Geneseq Database accession No. BAP97938 "Pantoea dispersa strain KACC91642P 16S rDNA sequence, SEQ ID 1." Aug. 15, 2013, 1 Page.
Database EMBL [Online] Oct. 1, 2001, 2 Pages, "Setosphaeria monoceras 28S ribosomal RNA gene, partial sequence," XP002777918, retrieved from EBI accession No. EM_STD:AY016368 Database accession; No. AY016368 sequence.
NCBI, GenBankAccession No. XP_002568042, Aug. 14, 2009, 4 Pages, Berg, V.D., et al., "Genome sequencing and analysis of the filamentous fungus," Nat. Biotechnol. 26 (10), 1161-1168 (2008).
Gilmour, S. J., et al., "Overexpression of the *Arabidopsis* CBF3 Transcriptional Activator Mimics Multiple Biochemical Changes Associated with Cold Acclimation," Plant Physiol., 2000, pp. 1854-1865, vol. 124.
Giraldo, A., et al., "Phylogeny of Sarocladium (Hypocreales)," Persoonia, 2015, pp. 10-24, vol. 34.
Gitaitis, R., et al., "The Epidemiology and Management of Seedborne Bacterial Diseases," Annu Rev Phytopathol., 2007, pp. 371-397, vol. 45.
Goudjal, Y., et al., "Biocontrol of Rhizoctonia solani damping-off and promotion of tomato plant growth by endophytic actinomycetes isolated from native plants of Algerian Sahara", Microbiological Research, 2014, vol. 169, No. 1, pp. 59-65.
Govindarajan, M. et al., "Effects of the Inoculation of Burkholderia vietnamensis and Related Endophytic Diaztrophic Bacteria on Grain Yield of Rice", Microbiol Ecology, Apr. 4, 2007, 17 Pages.
Grondona, I., et al., "Tusal®, a commercial biocontrol formulation based on Trichoderma," Bulletin OILB/SROP, 2004, pp. 285-288, vol. 27, No. 8.
Gu, O., et al., "*Glycomyces sambucus* sp. nov., an endophytic actinomycete islolated from the stem of Sambucus adnata Wall," International Journal of Systematic and Evolutionary Microbiology, 2007, pp. 1995-1998, vol. 57.
Guo, X., et al., "Red Soils Harbor Diverse Culturable Actinomycetes That Are Promising Sources of Novel Secondary Metabolites", Applied and Environmental Microbiology, Feb. 27, 2015, vol. 81, No. 9, pp. 3086-3103.
Haake, V., et al., "Transcription Factor CBF4 is a Regulator of Drought Adaptation in *Arabidopsis*," Plant Physiol., 2002, pp. 639-648, vol. 130.
Haas, D., et al., "R Factor Variants with Enhanced Sex Factor Activity in Pseudomonas aeruginosa," Mol Gen Genet., 1976, pp. 243-251, vol. 144.
Hahm, M-S., et al., "Biological Control and Plant Growth Promoting Capacity of Rhizobacteria and Pepper Under Greenhouse and Field Conditions," The Journal of Microbiology, The Microbiological Society of Korea, Heidelberg, Jun. 30, 2012, pp. 380-385, vol. 50, No. 3.
Hain, T., et al., "Chitinolytic transgenes from Streptomyces albidoflavus as phytochemicals defences against; herbivorous insects, use in transgenic plants and effect in plant development", International Journal of Systematic Bacteriology, Jan. 1997, vol. 47, No. 1, pp. 202-206.
Hallman, J., et al., "Bacterial Endophytes in Agricultural Crops," Canadian J Microbiol., 1997, pp. 895-914, vol. 43.
Hamayun, M., et al., "Cladosporium sphaerospermum as a new plant growth-promoting endophyte from the roots of Glycine max (L.) Merr," World Journal of Microbiology and Biotechnology, Kluwer Academic Publishers, DO, vol. 25, No. 4, Feb. 15, 2009 (Feb. 15, 2009), pp. 627-632.
Hanshew, A., et al., "Characterization of Actinobacteria Associated with Three Ant-Plant Mutualisms", Microbiol Ecology, Aug. 6, 2014, vol. 69, No. 1, pp. 192-203.
Hanson, L.E., "Reduction of Verticillium Wilt Symptoms in Cotton Following Seed Treatment with Trichoderma virens," The Journal of Cotton Science, 2000, pp. 224-231, vol. 4, No. 4.
Vujanovic, V., et al., "Mycovitality—a new concept of plant biotechnology," Canadian Journal Plant Pathol. 2007, vol. 29, p. 451.
Vujanovic, V., et al., "19th International Conference on *Arabidopsis*. Research Proceedings—ICAR13," Jul. 23-27, 2008, 264 Pages, Montreal, QC, Canada.
Vujanovic, V., et al., "Mycovitality and mycoheterotrophy: where lies dormancy in terrestrial orchid and plants with minute seeds?" Symbiosis, 2007, vol. 44, pp. 93-99.
Vujanovic, V., et al., "Seed endosymbiosis: a vital relationship in providing prenatal care to plants," Can. J. Plant Sci., NRC Research Press, Feb. 6, 2017, pp. 972-981, vol. 97.
Vujanovic, V., et al: "Fungal communities associated with durum wheat production system: A characterization by growth stage, plant organ and preceding crop", Crop Protection, Elsevier Science, GB, vol. 37, Feb. 19, 2012, pp. 26-34.
Waller, F., et al., "The Endophytic Fungus *Piriformospora indica* Reprograms Barley to Salt-Stress Tolerance, Disease Resistance, and Higher Yield," PNAS, 2005, pp. 13386-13391, vol. 102, No. 38.
Wang, B., et al., "Fungal endophytes of native *Gossypium* species in Australia," Mycological Research, 2007, pp. 347-354, vol. 111, No. 3.
Wang, K., et al., "Monitoring in Planta Bacterial Infection at Both Cellular and Whole-Plant Levels Using the Green Fluorescent Protein Variant GFPuv," New Phytol., 2007, pp. 212-223, vol. 174.
Wang, L. et al. Application of Bioorganic Fertilizer Significantly Increased Apple Yields and Shaped Bacterial Community Structure in Orchard Soil.
Wang, Q., et al., "Naive Bayesian Classifier for Rapid Assignment of rRNA Sequences into the New Bacterial Taxonomy," Appl. Environ. Microbiol., 2007, pp. 5261-5267, vol. 73, No. 16.

(56) References Cited

OTHER PUBLICATIONS

Waqas, M., et al., "Endophytic Fungi Produce Gibberellins and Indoleacetic Acid and Promotes Host-Plant Growth during Stress," Molecules, 2012, pp. 10754-10773, vol. 17.

Weaver, P.F., et al., "Characterization of Rhodopseudomonas capsulata," Arch Microbiol., 1975, pp. 207-216, vol. 105.

Weindling, R., "Relation of dosage to control of cotton seedling diseases by seed treatment," Plant Disease Reporter, 1943, 27, pp. 68-70.

Welty, R.E., et al., "Influence of Moisture Content, Temperature, and Length of Storage onSeed Germination and Survival of Endophytic Fungi in Seeds of Tall Fescue and Perennial Ryegrass," Phytopathyol., 1987, pp. 893-900, vol. 77, No. 6.

Whelehan, et al., "Microencapsulation using vibrating technology," Journal of Microencapsulation 2011, vol. 28(8), pp. 669-688.

White, J. F., et al., "A Proposed Mechanism for Nitrogen Acquisition by Grass Seedlings Through Oxidation of Symbiotic Bacteria," Symbiosis, 2012, pp. 161-171, vol. 57.

Xu, M., et al., "Bacterial Community Compositions of Tomato (*Lycopersicum esculentum* Mill.) Seeds and Plant Growth Promoting Activity of ACC Deaminase Producing Bacillus subtilis (HYT-12-1) on Tomato Seedlings" World J Microbiol Biotechnol., 2014, pp. 835-845, vol. 30.

Xu, Y., et al., "Biosynthesis of the Cyclooligomer Despipeptide bassianolide, an Insecticidal Virulence Factor of Beauveria bassiana," Fungal Genetics and Biology, 2009, pp. 353-364, vol. 46.

Xue, Q.Y., et al., "Evaluation of the Strains of Acinetobacter and Enterobacter as potential Biocontrol Agents Against Ralstonia Wilt of Tomato," Biological Control, 2009, vol. 48, pp. 252-258.

Yandigeri, M. S., et al., "Drought-tolerant endophytic actinobacteria promote growth of wheat (*Triticum aestivum*) under water stress conditions," Plant Growth Regulation, 2012, pp. 411-420, vol. 68.

Yashiro et al., "Effect of Streptomycin Treatment on Bacterial Community Structure in the Apple Phyllosphere," PLOS ONE, May 21, 2012, vol. 7, No. 5, 10 pages.

Yennamalli, R., et al., "Endoglucanases: insights into thermostability for biofuel applications", Biotech Biofuels, 2013, vol. 6, Issue 136, pp. 1-9.

Yezerski, A., et al., "The Effects of the Presence of Stored Product Pests on the Microfauna of a Flour Community," Journal of Applied Microbiology, 2005, pp. 507-515, vol. 98.

Youssef, Y.A., et al., "Production of Plant Growth Substances by Rhizosphere Myoflora of Broad Bean and Cotton," Biologia Plantarum, 1975, pp. 175-181, vol. 17, No. 3.

Zhang, Y., et al., "BcGsl, a glycoprotein from Botrytis cinerea, elicits defence response and improves disease resistance in host plants. Biochemical and biophysical research communications," Biochemical and Biophysical Research Communications, 2015, vol. 457, No. 4, pp. 627-634.

Zhang, W., et al., Host range of Exserohilum monoceras, a potential bioherbicide for the control of *Echinochloa* species, Canadian Journal of Botany/ Journal Canadien De Botan, National Research Council, Ottawa, CA, vol. 75, Jan. 1, 1997, pp. 685-692.

Zhang, J., et al. "Isolation and Characterization of Plant Growth-Promoting Rhizobacteria from Wheat Roots by Wheat Germ Agglutinin Labeled with Fluorescein Isothiocyanate", The Journal Of Microbiology, Apr. 27, 2012, vol. 50, No. 2, pp. 191-198, GenBank Accession No. JN210900.

Zhao, J.H., et al., "Bioactive secondary metabolites from *Nigrospora* sp. LLGLM003, an endophytic fungus of the medicinal plant *Moringa oleifera* Lam." World Journal of Microbiology and Biotechnology, Kluwer Academic Publishers, Feb. 12, 2012, pp. 2107-2112, vol. 28, No. 5.

Zhou, W., et al., "Effects of the Fungal Endophyte *Paecilomyces* sp. in Cotton on the Roo-Knot Nematode *Meloidogyne incognita*," poster dated Jan. 7, 2013.

Zhao, Jun, et al., "Effects of organic-inorganic compound fertilizer with reduced chemical fertilizer application on crop yields, soil biological activity and bacterial community structure in a rice-wheat cropping system," Applied Soil Ecology, vol. 99, Nov. 28, 2015, pp. 1-12, XP055530937.

Zhu et al., "*Helminthosporium velutinum* and *H. aquaticum* sp. nov. from aquatic habitats in Yunnan Province, China." Phytotaxa, 2016, vol. 253, No. 3, pp. 179-190.

Zimmerman, N.B., et al., "Fungal Endophyte Communities Reflect Environmental Structuring Across a Hawaiian Landscape," Proc Natl Acad Sci USA, 2012, pp. 13022-13027, vol. 109, No. 32.

Zuniga, A., et al., "Quorum Sensing and Indole-3-Acetic Acid Degradation Play a Role in Colonization and Plant Growth Promotion of *Arabidopsis thaliana* by Burkholderia phytofirmans PsJN," Mol Plant Microbe Interact., 2013, pp. 546-553, vol. 26, No. 5.

PCT International Search Report and Written Opinion for PCT/AU2018/050387, mailed Jul. 12, 2018, 8 pages.

PCT International Search Report and Written Opinionfor PCT/US2018/051467, Mar. 25, 2019 26 pages.

PCT Invitation to Pay Additional Fees, PCT Application No. PCT/CA2013/000091, Mar. 27, 2013, 2 Pages.

PCT International Search Report and Written Opinion for PCT/CA2013/000091, Sep. 20, 2013, 17 Pages.

PCT International Search Report and Written Opinion for PCT/EP2013/062976, Dec. 22, 2014, 9 Pages.

PCT International Search Report, Application No. PCT/US2014/044427, Dec. 3, 2014, 9 Pages.

PCT International Search Report and Written Opinion, Application No. PCT/US2014/054160, Dec. 9, 2014, 21 Pages.

PCT Invitation to Pay Additional Fees, PCT Application No. PCT/US2014/064411, Feb. 5, 2015, 2 Pages.

PCT International Search Report and Written Opinion, International Application No. PCT/US2014/064411, Mar. 27, 2015, 15 Pages.

PCT Invitation to Pay Additional Fees, PCT Application No. PCT/US2014/072399, Apr. 14, 2015, 2 Pages.

PCT International Search Report and Written Opinion, International Application No. PCT/US2014/072399, Jun. 26, 2015, 22 Pages.

PCT Invitation to Pay Additional Fees, PCT Application No. PCT/US2014/072400, Apr. 16, 2015, 6 Pages.

PCT International Search Report and Written Opinion, Application No. PCT/US2014/072400, Jul. 8, 2015, 38 Pages.

PCT International Search Report and Written Opinion, Application No. PCT/AU2015/000360, Aug. 5, 2015, 12 Pages.

PCT Invitation to Pay Additional Fees, PCT Application No. PCT/US2015/038110, Sep. 22, 2015, 8 Pages.

PCT Invitation to Pay Additional Fees, PCT Application No. PCT/US2015/038187, Oct. 14, 2015, 5 Pages.

PCT International Search Report and Written Opinion, PCT Application No. PCT/US2015/038187, Jan. 22, 2016, 36 Pages.

Bragantia, et al, "Identificaqao e Avaliaqao de Rizobacterias Isoladas de Raizes de Milho," Jan. 1, 2010, pp. 905-911, Retrieved from the Internet: URL:http://www.scielo.br/pdf/brag/v69n4/v69n4a17.pdf (With English Abstract).

Brinkmeyer, R., et al., "Uncultured Bacterium Clone ARKMP-100 16S Ribosomal RNA Gene, Partial Sequence," NCBI GenBank Accession No. AF468334, Submitted Jan. 14, 2002.

Brodie, E.L., et al., "Uncultured Bacterium Clone BANW722 16S Ribosomal RNA Gene, Partial Sequence," NCBI GenBank Accession No. DQ264636, Submitted Oct. 25, 2005, 1 Page.

Bulgarelli, D., et al., "Structure and Functions of the Bacterial Microbiota of Plants," Annu Rev Plant Biol., 2013, pp. 807-838, vol. 64.

Büttner, D., et al., "Regulation and secretion of Xanthomonas virulence factors," FEMS Microbiology Reviews, 2010, pp. 107-133, vol. 34, No. 2.

Caporaso, J.G., et al., "Ultra-High-Throughput Microbiol Community Analysis on the Illumina HiSeq and MiSeq Platforms," ISME J., 2012, pp. 1621-1624, vol. 6.

Castillo, D., et al., "Fungal Entomopathogenic Endophytes: Negative Effects on Cotton Aphid Reproduction in Greenhouse and Field Conditions," Power Point Presentation dated Mar. 23, 2013, 21 Pages.

Castillo, D., et al., "Fungal Endophytes: Plant Protective Agents Against Herbivores," Power Point Presentation dated Aug. 4, 2013.

(56) References Cited

OTHER PUBLICATIONS

Cavalier-Smith, T., "A Revised Six-Kingdom System of Life," Biol Rev Camb Philos Soc., 1998, pp. 203-266, vol. 73.
Cha, C., et al., "Production of Acyl-Homoserine Lactone Quorum-Sensing Signals by Gram-Negative Plant Associated Bacteria," Mol Plant Microbe Interact., 1998, pp. 1119-1129, vol. 11, No. 11.
Chagas, F., et al., "A Mixed Culture of Endophytic Fungi Increases Production of Antifungal Polyketides," J. Chem Ecol., Oct. 2013, pp. 1335-1342, vol. 39.
Chenhua Li, et al., "Change in deep soil microbial communities due to long-term fertilization," Soil Biology and Biochemistry, vol. 75, Mar. 5, 2014, pp. 264-272, XP055530941.
Cheow, W.S., et al., "Biofilm-like Lactobacillus rhamnosus Probiotices Encapsulated in Algiinate and Carrageenan Microcapsules Exhibiting Enhanced Thermotolerance and Freeze-drying Resistance," Biomacromolecules 2013, vol. 14(9):3214-3222.
Chernin, L. S., et al., "Chitinolytic Activity in Chromobacterium violaceum: Substrate Analysis and Regulation by Quorum Sensing," J Bacteriol., 1998, pp. 4435-4441, vol. 180, No. 17.
Clark, E. M., et al., "Improved Histochemical Techniques for the Detection of Acremonium coenophilum in Tall Fescue and Methods of in vitro Culture of the Fungus," J Microbiol Methods, 1983, pp. 149-155, vol. 1.
Clarridge, J., "Impact of 16S rRNA Gene Sequence Analysis for Identification of Bacteria on Clinical Microbiology and Infectious Diseases," Clinical Microbiology Reviews, Oct. 2004, pp. 840-862, vol. 17, No. 4.
Clay, K., "Effects of fungal endophytes on the seed and seedling biology of Lolium perenne and Festuca arundinacea," Oecologia, 1987, pp. 358-362, vol. 73.
Clough, S. J., et al., "Floral Dip: A Simplified Method for Agrobacterium-mediated Transformation of *Arabidopsis thaliana*," Plant J., 1998, pp. 735-743, vol. 16, No. 6.
Compant, S., et al., "Endophytes of Grapevines Flowers, Berries, and Seeds: Identification of Cultivable Bacteria, Comparison with Other Plant Parts, and Visualization of Niches of Colonization," Microbial Ecology, 2011, pp. 188-197, vol. 62.
Compant, S., et al., "Endophytic colonization of Vitis vinfera L. by Burkholderia phytofirmans strain PsJN: from the hizosphere to inflorescence tissues," FEMS Microbiol Ecol, 2008, pp. 84-93, vol. 63.
Conn, V. M., "Effect of Microbial Inoculants on the Indigenous Actinobacterial Endophyte Population in the Roots of Wheats as Determined by Terminal Restriction Fragment Length Polymorphism," Applied and Environmental Microbiology, 2004, pp. 6407-6413, vol. 70, No. 11.
Cottyn, B., et al., "Phenotypic and genetic diversity of rice seed-associated bacteria and their role in pathogenicity and biological control," Journal of Applied Microbiology, 2009, pp. 885-897, vol. 107.
Cox, C. D., "Deferration of Laboratory Media and Assays for Ferric and Ferrous Ions," Methods Enzymol., 1994, pp. 315-329, vol. 235.
Craine, J. M., et al., "Global Diversity of Drought Tolerance and Grassland Climate-Change Resilience," Nature Climate Change, 2013, pp. 63-67, vol. 3.
Dalal, J.M., et al., "Utilization of Endophytic Microbes for Induction of Systemic Resistance (ISR) in Soybean (*Glycine max* (L) Merril) Against Challenge Inoculation with R. solani," Journal of Applied Science and Research, 2014, pp. 70-84, vol. 2, No. 5.
Danhorn, T., et al., "Biofilm Formation by Plant-Associated Bacteria," Annu Rev Microbiol., 2007, pp. 401-422, vol. 61.
Daniels, R., et al., "Quorum Signal Molecules as Biosurfactants Affecting Swarming in Rhizobium etli," PNAS, 2006, pp. 14965-14970, vol. 103, No. 40.
Darsonval, A., et al., "Adhesion and Fitness in the Bean Phyllosphere and Transmission to Seed of *Xanthomonas fuscans* subsp. *fuscans*," Molecular Plant-Microbe Interactions, 2009, pp. 747-757, vol. 22, No. 6.
Darsonval, A., et al., "The Type III Secretion System of *Xanthomonas fuscans* subsp. *fuscans* is involved in the Phyllosphere Colonization Process and in Transmission to Seeds of Susceptible Beans," Applied and Environmental Microbiology, 2008, pp. 2669-2678, vol. 74, No. 9.
Dbget, "Orthology: K14454," 2005, 2 pages, can be retrieved at <URL:http://www.genome.jp/dbget-bin/wwwbget?ko:K14454>.
De Freitas, J. R., et al., "Phosphate-Solubilizing Rhizobacteria Enhance the Growth and Yield but not Phosphorus Uptake of Canola (*Brassica napus* L.)," Biol Fertil Soils, 1997, pp. 358-364, vol. 24.
De Santi, M. et al., "A combined morphologic and molecular approach for characterizing fungal microflora from a traditional Italian cheese (*Fossa cheese*)," Inter. Dairy J., 2010, vol. 10, No. 7, pp. 465-471.
De Lima Favaro, L. C., et al., "Epicoccum nigrum P16, a Sugarcane Endophyte, Produces Antifungal Compounds and Induces Root Growth," PLoS One, 2012, pp. 1-10, vol. 7, No. 6.
De Medeiros, L., et al., "Evaluation of Herbicidal Potential of Depsides from Cladosporium uredinicola an Endophytic Fungus found in Guava Fruit," J. Braz. Chem. Soc., 2012, vol. 23, No. 8, p. 1551-1557.
De Souza, J. J., et al., "Terpenoids from Endophytic Fungi," Molecules, 2011, pp. 10604-10618, vol. 16, No. 12.
Dennis, C., et al., "Antagonistic Properties of Species Groups of Trichoderma," Trans Brit Mycol Soc, 1971, pp. 25-39, vol. 57, No. 1.
Desiro, A., et al., "Detection of a novel intracellular microbiome hosted in arbuscular mycorrhizal fungi," ISME Journal, 2014, pp. 257-270, vol. 8.
Don, R.H., et al., "Properties of Six Pesticide Degradation Plasmids Isolated From Alcaligenes Paradoxus and Alcaligenes eutrophus," J Bacteriol., 1981, pp. 681-686, vol. 145, No. 2.
Eberhard, A., et al., "Structural Identification of Autoinducer of Photobacterium fischeri Luciferase," Biochem., 1981, pp. 2444-2449, vol. 20.
Edgar, R. C., "Search and Clustering Orders of Magnitude Faster than BLAST," Bioinformatics, 2010, pp. 2460-2461, vol. 26, No. 19.
Edgar, R. C., "UPARSE: Highly Accurate OTU Sequences From Microbial Amplicon Reads," Nat. Methods, 2013, pp. 996-998, vol. 10, No. 10.
Ek-Ramos, M. J., "Ecology, Distribution and Benefits of Fungal Endophytes Isolated from Cultivated Cotton (*Gossypium hirsutum*) in Texas," Power Point Presentation dated Nov. 7, 2012, 27 Pages.
Ek-Ramos, M. J., et al., "Spatial and Temporal Variation in Fungal Endophyte Communities Isolated from Cultivated Cotton (*Gossypium hirsutum*)," PLoS ONE, 2013, vol. 8, No. 6, 13 Pages, e66049.
Ek-Ramos, M. J., et al., "Spatial and Temporal Variation in Fungal Endophyte Communities Isolated from Cultivated Cotton (*Gossypium hirsutum*)," Power Point Presentation dated Jan. 7, 2013.
El-Shanshoury, A. R., "Growth Promotion of Wheat Seedlings by Streptomyces atroolivaceus," Journal of Agronomy and Crop Science, 1989, pp. 109-114, vol. 163.
Emerson, D., et al., "Identifying and Characterizing Bacteria in an Era of Genomics and Proteomics," BioScience, 2008, pp. 925-936, vol. 58, No. 10.
Endre, G., et al., "A Receptor Kinase Gene Regulating Symbiotic Nodule Development," Nature, 2002, pp. 962-966, vol. 417.
Faria, D. C., et al., "Endophytic Bacteria Isolated from Orchid and Their Potential to Promote Plant Growth," World J Microbiol Biotechnol., 2013, pp. 217-221, vol. 29.
Fatima Z et al, "Antifungal activity of plant growth-promoting rhizobacteria isolates against Rhizoctonia solani in wheat", African Journal of Biotechnology, 2009, 8: 219-225.
Ferrando, L., et al., "Molecular and Culture-Dependent Analyses Revealed Similarities in the Endophytic Bacterial Community Composition of Leaves from Three Rice (*Oryza sativa*) Varieties," FEMS Microbiol Ecol., 2012, pp. 696-708, vol. 80.
Hanson, LE., "Reduction of Verticillium Wilt Symptoms in Cotton Following Seed Treatment with Trichoderma virens," Proceedings Beltwide Cotton Conferences, 2000, vol. 1. (Abstract), 1 Page.

(56) References Cited

OTHER PUBLICATIONS

Hardegree, S. P. et al., "Effect of Polyethylene Glycol Exclusion on the Water Potential of Solution-Saturated Filter Paper," Plant Physiol., 1990, pp. 462-466, vol. 92.
Hardoim, P.R., et al., "Assessment of Rice Root Endophytes and Their Potential for Plant Growth Promotion," In: Hardoim, P.R., Bacterial Endophytes of Rice—Their Diversity, Characteristics and Perspectives, Groningen, 2011, pp. 77-100.
Hardoim, P.R., et al., "Dynamics of Seed-Borne Rice Endophytes on Early Plant Growth Stages," PLoS ONE, 2012, vol. 7, No. 2, 13 Pages.
Harman, G.E., et al., "Symposium: biocontrol and biotechnological methods for controlling cotton pests," Proceedings of the Beltwide Cotton Production Research Conf., 1989, Memphis, Tennessee, USA, pp. 15-20. (Abstract).
Hepler, P. K., et al., "Polarized Cell Growth in Higher Plants," Annu Rev Cell Dev Biol., 2001, pp. 159-187, vol. 17.
Hiatt, E.E., et al., "Tall Fescue Endophyte Detection: Commerical Immunoblot Test Kit Compared with Microscopic Analysis," Crop Science, 1999, pp. 796-799, vol. 39.
Hibbett, D.S., et al., "A Higher-Level Phylogenetic Classification of the Fungi," Mycol Res., 2007, pp. 509-547, vol. 111.
Hill, N. S., et al., "Endophyte Survival during Seed Storage: Endophyte-Host Interactions and Heritability," Crop Sci., 2009, pp. 1425-1430, vol. 49.
Hill N. S., et al., "Endophyte Survival during Seed Storage: Endophyte-Host Interactions and Heritability," PowerPoint, Dept. Crop Soil Sciences, University of Georgia, Nov. 16, 2012, 3 Pages.
Hinton, D. M., et al., "Enterobacter cloacae is an endophytic symbiont of corn," Mycopathologia, 1995, pp. 117-125, vol. 129.
Hjort, K., et al., "Chitinase genes revealed and compared in bacterial isolates, DNA extracts and a metagenomic library from a phytopathogen-suppressive soil", FEMS Microbiology Ecology, Feb. 2010, vol. 71, No. 2, pp. 197-207.
Hoffman, M., et al., "Diverse Bacteria Inhabit Living Hyphae of Phylogenetically Diverse Fungal Endophytes," Applied and Environmental Microbiology, Jun. 2010, p. 4063-4075, vol. 76, No. 12.
Hoffman, M., et al., "Endohyphal Bacterium Enhances Production of Indole-3-Acetic Acid by a Foliar Fungal Endophyte," PLOS One, Sep. 24, 2013, pp. 1-8, vol. 8, Issue 9, e73132.
Howell, C.R., et al., "Induction of Terpenoid Synthesis in Cotton Roots and Control of Rhizoctonia solani by Seed Treatment with Trichoderma virens," Phytopathology, 2000, pp. 248-252, vol. 90, No. 3.
Hubbard, M., et al., 2011. "Agricultural Potential of Fungal Endophytes of Grasses, Cereals and Wheat," In: Wheat: Genetics, Crops and Food Production. Nova Science Publishers Hauppauge, pp. 333-345.
Hubbard, M., et al., "Fungal Endophytes Improve Wheat Seed Germination Under Heat and Drought Stress," Botany, 2012, pp. 137-149, vol. 90.
Humann, J., et al., "Complete genome of the onion pathogen Enterobacter cloacae EcWSU1," Standard in Genomic Sciences, Dec. 31, 2011, vol. 5, No. 3, pp. 279-286.
Hung, P.Q., et al., "Isolation and Characterization of Endophytic Bacteria in Soybean (*Glycine* Sp.)," Omonrice, 2004, pp. 92-101, vol. 12.
Idris, A., et al., "Efficacy of Rhizobacteria for Growth Promotion in Sorghum Under Greenhouse Conditions and Selected Modes of Action Studies," J Agr Sci., 2009, pp. 17-30, vol. 147.
Ikeda, S., et al., "The Genotype of The Calcium/Calmodulin-Dependent Protein Kinase Gene (CCaMK) Determines Bacterial Community Diversity in Rice Roots Under Paddy And Upland Field Conditions," Applied and Environmental Microbiology, 2011, pp. 4399-4405, vol. 77, No. 13.
Imoto, K., et al., "Comprehensive Approach to Genes Involved in Cell Wall Modifications in *Arabidopsis thaliana*," Plant Mol Biol., 2005, pp. 177-192, vol. 58.
Impullitti, A.E., et al., "Fungal endophyte diversity in soybean", Journal of Applied Microbiolog, vol. 114, No. 5, May 1, 2013, pp. 1500-1506.
Iverson, C., et al, "The taxonomy of Enterobacter sakazakii: proposal of a new genus *Cronobacter* gen. nov. and descriptions of *Cronobacter sakazakii* comb. nov. *Cronobacter sakazakii* subsp. *sakazakii*, comb. nov., *Cronobacter sakazakii* subsp. *malonaticus* subsp. nov., *Cronobacter turicensis* sp. nov., *Cronobacter muytjensii* sp. nov., *Cronobacter dublinensis* sp. nov. and *Cronobacter* genomospecies I", BMC Evolutionary Biology 2007, Apr. 17, 2017, 11 pages.
Janda, J.M., et al., "16S rRNA Gene Sequencing for Bacterial Identification in the Diagnostic Laboratory: Pluses, Perils, and Pitfalls," Journal of Clinical Microbiology, 2007, pp. 2761-2764, vol. 45, No. 9.
Joe, M.M et al., "Development of alginate-based aggregate inoculants of *Methylobacterium* sp. And *Azospirillum brasilense* tested under in vitro conditions to promote plant growth," Journal of Applied Microbiology 2013, 116(2):408-423, XP055225426, Nov. 22, 2013.
Johnston-Monje, D., et al., "Conservation and Diversity of Seed Associated Endophytes in *Zea* Across Boundaries of Evolution, Ethnography and Ecology," PLoS ONE, 2011, vol. 6, No. 6, 22 Pages.
Johnston-Monje, D., et al., "Plant and Endophyte Relationships: Nutrient Management," Comprehensive Biotechnol., 2011, pp. 713-727, vol. 4.
Johnston-Monje, D., "Microbial Ecology of Endophytic Bacteria in *Zea* Species as Influenced by Plant Genotype, Seed Origin, and Soil Environment," Thesis, University of Guelph, 2011, 230 Pages.
Jones, K.L., "Fresh Isolates of Actinomycetes in which the Presence of Sporogenous Aerial Mycelia is a Fluctuating Characteristic," J Bacteriol., 1949, pp. 141-145, vol. 57, No. 2.
Jung, C., et al., "The Effects of Endohyphal Bacteria on Anti-Cancer and Anti-Malaria Metabolites of Endophytic Fungi," Honors Thesis, University of Arizona, May 2012, 15 Pages.
Kaga, H., et al., "Rice Seeds as Sources of Endophytic Bacteria," Microbes Environ., 2009, pp. 154-162, vol. 24, No. 2.
Kalns, L., et al., "The Effects of Cotton Fungal Endophytes in the Field on Arthropod Community Structure," Power Point Presentation dated Jan. 7, 2013, 17 Pages.
Kanbar, A., et al., "Relationship between Root and Yield Morphological Characters in Rainfed Low Land Rice (*Oryza sativa* L.)," Cereal Research Communications, 2009, vol. 37, No. 2, pp. 261-268.
Kang, B. H., et al., "Members of the *Arabidopsis* Dynamin-Like Gene Family, ADL1, are Essential for Plant Cytokinesis and Polarized Cell Growth," Plant Cell, 2003, pp. 899-913, vol. 15.
Kasana, R. C., et al., "A Rapid and Easy Method for the Detection of Microbial Cellulases on Agar Plates Using Gram's Iodine," Curr Microbiol., 2008, pp. 503-507, vol. 57.
Khan, A.L., et al., "Salinity Stress Resistance Offered by Endophytic Fungal Interaction Between Penicillium miniouteum LHL09 and Glycine max. L," J. Microbiol. Biotechnol., 2011, pp. 893-902, vol. 21, No. 9.
Kim, M., et al., "Towards a taxonomic coherence between average nucleotide identity and 16S rRNA gene sequence similarity for species demarcation of prokaryotes", Int J Systematic Evolutionary Microbiol., 2014, vol. 64, pp. 346-351.
Klaubauf, S., et al., "Molecular diversity of fungal communities in agricultural soils from Lower Austria," Fungal Diversity, Aug. 13, 2010, pp. 65-75, vol. 44, No. 1.
Knapp, D., et al., "Inter- and intraspecific functional diversity of fungal root endophytes of semiarid sandy grasslands," Acta Microbiologica et Immunologica Hungarica, Nov. 2017, vol. 64, Issue Supplement 1, pp. 1-101.
Kruger, M., et al., "DNA-Based Species Level Detection of Glomeromycota: One PCR Primer Set for All Arbuscular Mycorrhizal Fungi," New Phytol., 2009, pp. 212-223, vol. 183.
Kuklinsky-Sobral, J., et al., "Isolation and Characterization of Endophytic Bacteria from Soybean (*Glycine max*) Grown in Soil Treated with Glyphosate Herbicide," Plant and Soil, 2005, pp. 91-99, vol. 273.

(56) References Cited

OTHER PUBLICATIONS

Kuklinsky-Sobral, J., et al., "Isolation and characterization of soybean-associated bacteria and their potential for plant growth promotion," Environmental Microbiology, 2004, pp. 1244-1251, vol. 6, No. 12.
Kumar, S., et al., "MEGA7: Molecular Evolutionary Genetics Analysis version 7.0 for bigger datasets," Molecular Biology and Evolution, Mar. 22, 2016, vol. 33, pp. 1870-1874.
Kumar, A., et al., "Bio-control potential of *Cladosporium* sp. (MCPL-461), against a noxious weed *Parthenium hysterophorus* L.," J. Environ Biol., Mar. 2009, pp. 307-312, vol. 30, Issue 2.
Kusari, S., et al. "Chemical ecology of endophytic fungi: origins of secondary metabolites," Cell Press, Chem & Biol, vol. 19, pp. 792-798, 2012.
Labeda, D.P., et al., "Phylogenetic study of the species within the family Streptomycetaceae," Antonie van Leeuwenhoek, 2012, vol. 101, pp. 73-104, Springer.
Lanver, D., et al., "Sho1 and Msb2-Related Proteins Regulate Appressorium Development in the Smut Fungus *Ustilago aydis*," Plant Cell, 2010, pp. 2085-2101, vol. 22.
Le, X.H., et al., "Isolation and characterisation of endophytic actinobacteria and their effect on the early growth and hodulation of lucerne (*Medicago sativa* L.)," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 134-136.
Lehman, S.G., "Treat Cotton Seed," Review of Applied Mycology, 1945, 24, 369, 16 Pages.
Shapiro-Ilan, D.I., et al., "The Potential for Enhanced Fungicide Resistance in Beauveria Bassiana Through Strain Discovery and Artificial Selection," Journal of Invertebrate Pathology, 2002, pp. 86-93, vol. 81.
Shankar, M., et al., "Root colonization of a rice growth promoting strain of Enterobacter cloacae," Journal of Basic Microbiology, 2011, pp. 523-530, vol. 51.
Sharma et al., "Detection and identification of bacteria intimately associated with fungi of the order Sebacinales", Cellular Microbiology, Aug. 5, 2008, pp. 2235-2246, vol. 10, No. 11.
Shiraishi, A., et al., "Nodulation in black locust by the ammaproteobacteria *Pseudomonas* sp. and the *Betaproteobacteria burkholderia* sp", Systematic and Applied Microbiology, vol. 33, No. 5, Aug. 2010, pp. 269-274.
Simola, L., et al., "The Effect of Some Protein and Non-Protein Amino Acids on the Growth of Cladosporium herbarum and Trichotheeium roseum," Effect of Amino Acids on Fungi, Physiologia Plantarum, 1979, vol. 46, pp. 381-387.
Singh, A K., et al., "Uncultured *Actinomyces* sp. Clone EMLACT 80 IV (New) 16S Ribosomal RNA Gene, Partial Sequence," NCBI GenBank Accession No. JQ285908. Submitted Dec. 13, 2011, 1 page.
Soares, M. M. C. N., et al., "Screening of Bacterial Strains for Pectinolytic Activity: Characterization of the Polygalacturonase Produced by *Bacillus* SP," Revista de Microbiolgia, 1999, pp. 299-303, vol. 30.
Soe, K.M., et al., "Effects of endophytic actinomycetes and Bradyrhizobium japonicum strains on growth, nodulation, nitrogen fixation and seed weight of different soybean varieties," Soil Science and Plant Nutrition, 2012, pp. 319-325, vol. 58, No. 3.
Soe, K.M., et al., "Low-Density Co-Inoculation of Myanmar Bradyrhizobium yuanmingense MAS34 and Streptomyces griseoflavus P4 to Enhance Symbiosis and Seed Yield in Soybean Varieties," American Journal of Plant Sciences, 2013, pp. 1879-1892, vol. 4.
Sogonov, M.V., et al., "The hyphomycete *Teberdinia hygrophila* gen. nov., sp. nov. and related anamorphs of *Pseudeurotium* species," Mycologia, May 2005, pp. 695-709, vol. 97, No. 3.
Song, M., et al., "Effects of Neotyphodium Endophyte on Genmination of Hordeum brevisubulatum under Temperature and Water Stress Conditions," Acta Agrestia Sinica, 2010, pp. 834-837, vol. 18, No. 6. (English Abstract).
Souleimanov, A., et al., "The Major Nod Factor of Bradyrhizobium japonicum Promotes Early Growth of Soybean and Corn," J. Exp. Bot., 2002, pp. 1929-1934, vol. 53, No. 376.
Spiekermann, P., et al., "A Sensitive, Viable-Colony Staining Method Using Nile Red for Direct Screening of Bacteria that Accumulate Polyhydroxyalkanoic Acids and Other Lipid Storage Compounds," Arch Microbiol., 1999, pp. 73-80, vol. 171.
Staudt, A. K., et al., "Variations in Exopolysaccharide Production by Rhizobium tropici," Arch Microbiol., 2012, pp. 197-206, vol. 194.
Stielow, J.B., et al., "One fungus, which genes? Development and assessment of universal primers for potential secondary fungal DNA barcodes," Persoonia: Molecular Phylogeny and Evolution of Fungi, 2015, vol. 35, pp. 242-263.
Strobel, G. A., "Endophytes as Sources of Bioactive Products," Microbes and Infection, 2003, pp. 535-544, vol. 5.
Sturz, A. V., et al., "Weeds as a Source of Plant Growth Promoting Rhizobacteria in Agricultural Soils," Can J Microbiol., 2001, pp. 1013-1024, vol. 47, No. 11.
Surette, M.A., et al. "Bacterial Endophytes in Processing Carrots (*Daucus carota* L. var. *sativus*): Their Localization, Population Density, Biodiversity and Their Effects on Plant Growth," Plant and Soil, 2003, pp. 381-390, vol. 253, No. 2.
Suto, M., et al., "Endophytes as Producers of Xylanase," J Biosci Bioeng., 2002, pp. 88-90, vol. 93, No. 1.
Sword, G., "Manipulating Fungal Endophytes to Protect Plants from Insects and Nematodes," Power Point Presentation dated Aug. 7, 2013, 48 Pages.
Sword, G., et al., "Field Trials of Potentially Beneficial Fungal Endophytes in Cotton," Power Point Presentation dated Jan. 7, 2013, 17 Pages.
Sword, G., "Fungal Endophytes to Protect Cotton from Insects and Nematodes," Power Point Presentation dated Dec. 7, 2012, 20 Pages.
Sword, G., "Natural Enemies—The Forgotten Basis of IPM?," Power Point Presentation dated Sep. 6, 2013, 33 Pages.
Taghavi, S., et al., "Genome Survey and Characterization of Endophytic Bacteria Exhibiting a Beneficial Effect on Growth and Development of Poplar Trees," Applied and Environmental Microbiology, 2009, pp. 748-757, vol. 75, No. 3.
Taghavi, S., et al., "Genome Sequence of the Plant Growth promoting Endophytic Bacterium *Enterobacter* sp. 638", PLoS Genet., May 2010, vol. 6, Issue 5, e1000943, pp. 1-15.
Tamura, K., et al., "Estimation of the number of nucleotide substitutions in the control region of mitochondrial DNA in humans and chimpanzees," Molecular Biology and Evolution, 1993, vol. 10, No. 3, pp. 512-526.
Taylor, A.G., et al., "Concepts and Technologies of Selected Seed Treatments," Annu. Rev. Phytopathol., 1990, pp. 321-339, vol. 28.
Teather, R. M., et al., "Use of Congo Red-Polysaccharide Interactions in Enumeration and Characterization of Cellulolytic Bacteria from the Bovine Rumen," Appl Environ Microbiol., 1982, pp. 777-780, vol. 43, No. 4.
Thakur, A., et al., "Detrimental effects of endophytic fungus *Nigrospora* sp. on survival and development of Spodoptera litura," Biocontrol Science and Technology, Feb. 1, 2012, pp. 151-161, vol. 22, No. 2.
Thakur, A., et al., "Enhanced Resistance to Spodoptera litura in Endophyte Infected Cauliflower Plants," Environmental Entomology, Apr. 1, 2013, pp. 240-246, vol. 42, No. 2.
Thakur, A., et al., "Suppression of Cellular Immune Response in Spodoptera litura (Lepidoptera: Noctuidae) Larvae by Endophytic Fungi *Nigrospora oryzae* and *Cladosporium uredinicola*,", Annals of the Entomological Society of America, May 1, 2014, pp. 674-679, vol. 107, No. 3.
Thomas, L., et al., "Development of Resistance to Chlorhexidine Diacetate in Pseudomonas aeruginosa and the Effect of a "Residual" Concentration," J Hosp Infect., 2000, pp. 297-303, vol. 46.
Thomashow, M. F., "So What's New in the Field of Plant Cold Acclimation? Lots!," Plant Physiol., 2001, pp. 89-93, vol. 125.
Tokala, R. T., et al., "Novel Plant-Microbe Rhizosphere Interaction Involving Streptomyces Lydicus WYEC108 and the Pea Plant (*Pisum sativum*)," Applied and Environmental Microbiology, May 2002, pp. 2161-2171, vol. 68, No. 5.

(56) References Cited

OTHER PUBLICATIONS

Trotel-Aziz, P., et al., "Characterization of New Bacterial Biocontrol Agents *Acinetobacter, Bacillus, Pantoea* and *Pseudomonas* spp. Mediating Grapevine Resistance Against Botrytis cinerea," Environmental and Experimental Botany, 2008, pp. 21-32, vol. 64.
Truyens, S., et al., "Changes in the Population of Seed Bacteria of Transgenerationally Cd-Exposed *Arabidopsis thaliana*," Plant Biol., 2013, pp. 971-981, vol. 15.
U'ren, J.M., et al., "Host and geographic structure of endophytic and endolichenic fungi at the continental scale," American Journal of Botany, May 1, 2012, pp. 898-914, vol. 99, No. 5.
Usadel, B., et al., "The Plant Transcriptome—From Integrating Observations to Models," Front Plant Sci., 2013, pp. 1-3, vol. 4., Article 48, 3 Pages.
Vacheron, J., et al., "Plant Growth-Promoting Rhizobacteria and Root System Functioning," Frontiers Plant Sci., 2013, vol. 4, Article 356, 19 Pages.
Valencia, C. U., et al., "Endophytic Establishment as an Unintended Consequence of Biocontrol with Fungal Entomopathogens," Power Point Presentation dated Jan. 7, 2013, 10 Pages.
Valencia, E., et al., "Mini-review: Brazilian fungi diversity for biomass degradation," Fungal Genetics and Biology, 2013, pp. 9-18, vol. 60.
Van Der Lelie, D., et al., "Poplar and its Bacterial Endophytes: Coexistence and Harmony," Critical Rev Plant Sci., 2009, pp. 346-358, vol. 28.
Verkley, G., et al., "*Paraconiothyrium*, a new genus to accommodate the mycoparasite *Coniothyrium minitans*, anamorphs of Paraphaeosphaeria, and four new species," Studies in Mycology, 2004,; pp. 323-335, vol. 50.
Vining, K., et al., "Methylome Reorganization During in vitro Dedifferentiation and Regeneration of Populus trichocarpa," BMC Plant Biol., 2013, vol. 13, No. 92, 15 Pages.
Viruel, E., et al., "Pseudomonas thiveralensis Strain IEHa 16S Ribosomal RNA Gene, Partial Sequence," NCBI GenBank Accession No. GQ169380.1, Submitted May 15, 2009, 1 Page.
Visagie, C.M., et al., "Identification and nomenclature of the genus *Penicillium*," Studies in Mycology, Jun. 2014, pp. 343-371, vol. 78.
Vujanovic, V., et al., "Viability Testing of Orchid Seed and the Promotion of Colouration and Germination," Annals of Botany, Mar. 17, 2000, pp. 79-86, vol. 86.
Vujanovic, V., et al., "Endophytic hyphal compartmentalization is required for successful mycobiont-wheat interaction as revealed by confocal laser microscopy," The proceedings of the Soils and Crops conference in Saskatoon (2008) published 2009, 7 Pages.
Vujanovic, V., et al., "A comparative study of endophytic mycobiota in leaves of Acer saccharum in eastern North America," Mycological Progress, May 2002, pp. 147-154, vol. 1, Issue 2.
Vujanovic, V., et al.,"Orchid seed viability testing by fungal bioassays and molecular phylogeny," Floriculture, ornamental and plant biotechnology, 2006, vol. 63, pp. 563-569.
European Patent Office, European Search Report, European Patent Application No. 20171870.7, dated Mar. 1, 2021, 15 Pages.
GenBank Accession NR_041978, dated Aug. 8, 2011. (Year: 2011).
GenBank Accession AF394537, dated Jul. 2, 2002. (Year: 2002).
Andreolli, M., et al., "Endophytic Burkholderia fungorum DBT1 can improve phytoremediation efficiency of polycyclic aromatic hyrocarbons", Chemosphere, Pergamon Press, Oxford, GB, vol. 92, No. 6, May 21, 2013, pp. 688-694.
Extended European Search Report for EP 20202875.9, 16 pages.
Douglas, G., et al., "PICRUSt2 for prediction of metagenome functions", Nature Biotechnology, vol. 38, No. 6, Jun. 1, 2020, pp. 685-688.
Kemp, N., et al., "Sarocladium zeae is a systemic endophyte of wheat and an effective biocontrol agent against Fusarium head blight", Biological Control, vol. 149, Publication No. 104329, 10 pages (2020).
Wicklow, D., et al., "A protective endophyte of maize: Acremonium zeae antibiotics inhibitory to Aspergillus flavus and Fasarium verticillioides", Mycol. Res. 109 (5):610-618 (May 2005).
Pan, J., et al., "Effects of host plant environment and Ustilago maydis infection on the fungal endophyte community of maize (*Zea mays*)", New Phytologist, vol. 178, pp. 147-156 (2008).
Wicklow, D., et al., "Occurrence of pyrrocidine and dihydroresorcylide production among Acremonium zeae populations from maize grown in different regions", Canadian Journal of Plant Pathology, vol. 30, pp. 425-433 (2008).
European Patent Office, Partial European Search Report, European Patent Application No. 18791606.9, Jul. 26, 2021, 16 Pages.
Abaid-Ullah, M., et al., "Plant Growth Promoting Rhizobacteria: An Alternate Way to Improve Yield and Quality of Wheat (*Triticum aestivum*)", International Journal of Agriculture and Biology, vol. 17, No. 1, Jan. 1, 2015, pp. 51-60.
Colla, G., et al., "Coating seeds with endophytic fungi enhances growth, nutrient uptake, yield and grain quality of winter wheat", International Journal of Plant Production, vol. 9, No. 2, Apr. 1, 2015, pp. 171-190.
Larran, S., et al., "Endophytes from wheat as biocontrol agents against tan spot disease", Biological Control, vol. 92, Sep. 11, 2015, pp. 17-23.
European Patent Office, Search Report, European Patent Application No. 17825317.5, Oct. 12, 2021, 9 Pages.
Yuan, J., et al., "Roots from distinct plant developmental stages are capable of rapidly selecting their own microbiome without the influence of environmental and soil edaphic factors", Soil Biology and Biochemistry 89 (2015): 206-209.
Frichot, E., et al., "Testing for Associations between loci and environmental gradients using latent factor mixed models", Mol. Biol. Evol. 30:7 1687-1699 (Year: 2013).
Bicego, M., et al., "Investigating Topic Models' Capabilities in Expression Microarray Data Classification", IEEE/transactions on computational biology and bioinformatics, 9:8 1831-1836 (Year: 2012).
Gerber, G., et al., "Inferring Dynamic Signatures of Microbes in Complex Host Ecosystems", PLOS Computational Biology 8:8 e1002624, 14 pages (Year: 2012).
Holmes, I., et al., "Dirichlet Multinomial Mixtures: Generative Models for Microbial Metagenomics", PLoSONE 7:2, e30126, 15 pages (Year: 2012).
Kim, Y., et al., "Deciphering the human microbiome using next-generation sequencing data and bioinformatics approaches", Methods 79-80, p. 52-59 (Year: 2015).
Anesi, A., et al., "Towards a scientific interpretation of the terrior concept: platicisity of the grape berry metabolome", BMP plant biology 15:191, 17 pages (Year: 2015).
Hill, S.T., The pursuit of hoppiness: propelling hop into the genomic era. Thesis, Oregon State University, 80 pages (Year: 2016).
Li, M., et al., "Persistent homology and the branching topologies of plants", American Journal of Botany, 104:3, 349-353 (Year: 2017).
Schuerger, A., "Microbial Ecology of a Crewed Rover Traverse in the Arctic: Low Microbial Dispersal and Implications for Planetary Protection on Human Mars Missions", Astrobiology, vol. 15, No. 6, 2015, pp. 478-491.
Timmusk, S., "Paenibacillus polymyxa antagonizes oomycete plant pathogens *Phytophthora palmivora* and *Pythium aphanidermatum*", Journal of Applied Microbiology, GB, vol. 105, No. 5, Jan. 5, 2009, pp. 1473-1481.
Fatima, Z., "Antifungal activity of plant growth-promoting rhizobacteria isolates against Rhizoctonia solani in wheat", African Journal of Biotechnology, vol. 8(2), pp. 219-225, Jan. 19, 2009, pp. 219-225.
GenBank Accession No. AY148074 published Nov. 30, 2002.
GenBank Accession No. FM998026 published Feb. 10, 2011.
GenBank Accession No. KJ494315 published May 3, 2014.
International Search Report and Written Opinion for PCT/US2022/026051, 38 pages.
Langner Dos Santos Miriam et al: "Benefits Associated with the Interaction of Endophytic Bacteria and Plants", Brazilian Archives of Biology and Technology, vol. 61, No. 0, Jan. 1, 2018 (Jan. 1, 2018), pp. 18160431-2018.
Database GenBank [Online] NIH; Jan. 29, 2016 (Jan. 29, 2016), Wu JR: "Chitinophaga pinensis strain CSB3-50 16S ribosomal RNA gene", XP055948434, accession No. KU305719 Database accession No. KU305719.1 abstract.

(56) References Cited

OTHER PUBLICATIONS

Database GenBank [Online] NIH; Mar. 10, 2017 (Mar. 10, 2017), Shaffer JP et al: "Uncultured bacterium clone EHB-PS0362 16S ribosomal RNA gene", XP055948435, accession No. KU978322 Database accession No. KU978322.1 abstract.
Database GenBank [Online] NIH; Jan. 15, 2019 (Jan. 15, 2019), Hu C. J. et al: "*Chitinophaga* sp. strain N15203 16S ribosomal RNA gene", XP055948438, accession No. MK389338 Database accession No. MK389338.1 abstract.
Database GenBank [Online] NIH; Nov. 26, 2014 (Nov. 26, 2014), Han J. H. et al: "*Chitinophaga* sp. NR 1-07 16S ribosomal RNA gene", XP055948440, accession No. KM253104 Database accession No. KM253104.1 abstract.
Database GenBank [Online] NIH; Sep. 2, 2017 (Sep. 2, 2017), Jiayu T. J.: "*Chitinophaga* sp. strain PRd7 16S ribosomal RNA gene", XP055948441, accession No. KY203972 Database accession No. KY203972.1 abstract.
Database GenBank [Online] NIH; Oct. 1, 2010 (Oct. 1, 2010), Aslam Z. et al: "*Chitinophaga* sp. Z2-YC6856 16S ribosomal RNA gene", XP055948442, accession No. GQ369124 Database accession No. GQ369124.1 abstract.
Database GenBank [Online] NIH; Jun. 10, 2014 (Jun. 10, 2014), Zhang B. G.: "Chitinophaga oryziterrae strain ZBGKL4 16S ribosomal RNA gene", XP055948443, accession No. KJ734873 Database accession No. KJ734873.1 abstract.
Chung, E., et al: *Chitinophaga oryziterrae* sp. nov., isolated from the rhizosphere soil of rice (*Oryza sativa* L.) II, International Journal of Systematic and Evolutionary Microbiology, vol. 62, No. Pt_12, Dec. 1, 2012 (Dec. 1, 2012), pp. 3030-3035.
Proença Diogo Neves et al: "*Chitinophaga costaii* sp. nov., an endophyte of Pinus pinaster, and emended description of Chitinophaga niabensis", International Journal of Systematic and Evolutionary Microbiology, vol. 64, No. Pt_4, Apr. 1, 2014 (Apr. 1, 2014), pp. 1237-1243.
Elad, Y., et al: "Control of Rhizoctonia solani in cotton by seed-coating with *Trichoderma* spp. spores", Plant and Soil, vol. 66, No. 2, Jun. 1, 1982 (Jun. 1, 1982), pp. 279-281.
Harman, G.E., et al: "Trichoderma hamatum effects on seed and seedling disease induced in radish and pea by *Pythium* spp. or *Rhizoctonia solani*", Phytopathology, Dec. 1, 1980 (Dec. 1, 1980), pp. 1167-1172.
Harman, G.E., et al: "Factors affecting Trichoderma hamatum applied to seeds as a biocontrol agent", Phytopathology, Jun. 1, 1981 (Jun. 1, 1981), pp. 569-572.
Giczey, G., et al: "Homologous transformation of Trichoderma hamatum with an endochitinase encoding gene, resulting in increased levels of chitinase activity", FEMS Microbiology Letters, Jan. 1, 1998 (Jan. 1, 1998), pp. 247-252.
Freitas, R., et al: "Cloning and characterization of a protein elicitor Sml gene from Trichoderma harzianum", Biotechnology Letters, vol. 36, No. 4, Dec. 10, 2013 (Dec. 10, 2013), pp. 783-788.
Database Genbank [Online] NIH; Jan. 1, 2008 (Jan. 1, 2008), Hanada RE et al: "Trichoderma hamatum strain DIS 65G 18S ribosomal RNA gene, partial sequence; internal transcribed spacer 1", XP055973221, Database accession No. EU264000 abstract.
Database Genbank [Online] NIH; Sep. 6, 2013 (Sep. 6, 2013), Samuels G J et al: "Trichoderma hamatum strain Dis 240j actin (act) gene, partial eds", XP055973271, Database accession No. EU856256 abstract.
Database Genbank [Online] NIH; May 23, 2005 (May 23, 2005), Steyaert J M et al: "Trichoderma hamatum alkaline proteinase (prbl) gene, complete eds", XP055973243, Database accession No. AY258899 abstract.
Database Genbank [Online] NIH; Apr. 11, 2019 (Apr. 11, 2019), Chaverri P et al: "Trichoderma hamatum strain GJS 04-207 calmodulin (CAL) gene, partial eds", XP055973272, Database accession No. FJ442285 abstract.
Aerts A et al: "NCBI Reference Sequence: XP_024757499.1: glycoside hydrolase family 18 protein [Trichoderma asperellum CBS 433. 97]", Apr. 26, 2018 (Apr. 26, 2018), pp. 1-2, XP055973177.

Database Genbank [Online] NIH; Jul. 25, 2016 (Jul. 25, 2016), Steyaert J M et al: "Trichoderma hamatum endochitinase (chit42) gene, partial eds", XP055973252, Database accession No. AY258898 abstract.
Database Genbank [Online] NIH; Sep. 25, 1998 (Sep. 25, 1998), Giczey G et al: "endochitinase [Trichoderma hamatum] ", XP055973364, Database accession No. AAC60385 abstract.
Database Genbank [Online] NIH; Sep. 25, 1998 (Sep. 25, 1998), Giczey G et al: "Trichoderma hamatum endochitinase gene, complete eds", XP055973251, Database accession No. U88560 abstract.
Liu, H.J., et al., "Bacillus subtilis strain A2-9 16S ribosomal RNA gene, partial sequence", Accession No. JF496331, deposited Aug. 2011.
Li, C., et al., "Bacillus subtilis strain B2-1 16S ribosomal RNA gene, partial sequence", Accession No. JN256114, deposited Sep. 2011.
Jiang, L., "Bacillus subtilis strain jllsy 16S ribosomal RNA gene, partial sequence", Accession No. FJ793201, deposited Apr. 2009.
Choi, N.S., et al., "Bacillus licheniformis strain DJ-2 16S ribosomal RNA gene, partial sequence", Accession No. FJ435676, deposited Jan. 2009.
Peng, S., et al., "Bacillus subtilis strain CCM9 16S ribosomal RNA gene, partial sequence", Accession No. HQ536000, deposited Dec. 2010.
Jee, H., et al., "Bacillus subtilis strain R2-1 16S ribosomal RNA gene, partial sequence", Accession No. EU852929, deposited Jul. 2009.
Zhao, Y., et al., "Bacillus amyloliquefaciens strain BGP14 16S ribosomal RNA gene, partial sequence", Accession No. JQ734536, deposited May 2012.
Sato, I., et al., "Suppressive Potential of Paenibacillus Strains Isolated from the Tomato Phyllosphere against Fusarium Crown and Root Rot of Tomato", Microbes Environ, vol. 29, No. 2, 168-177, 2014.
Combined printouts of term definitions from world wide web, performed by mkz Oct. 19, 2022 (Year: 2022).
Sarangi, S., et al., "Agricultural Activity Recognition with Smart-shirt and Crop Protocol", IEEE global humanitarian technology conference, p. 298-305 (Year: 2015).
Gibbs, A., et al., "Chemical Diversity: Definition and Quantification", IN Exploiting chemical diversity for drug discovery, Bartlett et al EDS. elBSN 978-1-84755-255-6 p. 137-160.
Peiffer, J., et al., "The Genetic Architecture of Maize Height", Genetics, vol. 196, p. 1337-1356 (Year: 2015).
Kazemian, M., et al., "Improved accuracy of supervised CRM discovery with interpolated Markov models and cross-specieis comparison", Nucleic Acids Research, 2011, vol. 39, No. 22, 9463-9472.
Yeh, J.H., "Protein Remote Homology Detection Based on Latent Topic Vector Model", International conference on Networking and information technology, p. 456-460, (Year: 2010).
Heydari, A., "A Review on Biological Control of Fungal Plant Pathogens Using Microbial Antagonists", Journal of Biological Sciences, vol. 10 (4) 273-290 (Year: 2010).
Sessitsch, A., et al., "Functional Characteristics of an Endophyte Community Colonizing Rice Roots as Revealed by Metagenomic Analysis", MPMP vol. 25, No. 1, 2012, pp. 28-36.
Muhammad, N., et al., "Endophytes in biotechnology and agriculture", E-Cost FA1103 Working Group Meeting in Trento/S. Michele, Italy Nov. 2012. (poster).
Hurek, T., et al., "*Azoarcus* sp. strain BH72 as a model for nitrogen-fixing grass endophytes", Journal of Biotechnology 106 (2003) 169-178.
Engelhard, M., et al., "Preferential occurrence of diazotrophic endophytes, *Azoarcus* spp., in wild rice species and races of *Oryza sativa* in comparison with moder races", Environmental Microbiology (2000) 2(2), 131-141.
Sessitsch, A., et al., "Endophytic bacterial communities of field-grown potato plants and their plant-growth-promoting and antagonistic abilities", Can. J. Microbiol. 50: 239-249 (2004).
Sessitsch, A., et al., "Cultivation-independent population analysis of bacterial endophytes in three potato varieties based on eubacterial

(56) References Cited

OTHER PUBLICATIONS and Actinomycetes-specific PCR of 16S rRNA genes", FEMS Microbiology Ecology 39 (2002) 23-32.

Minamisawa K., et al., "Anaerobic Nitrogen-Fixing Consortia Consisting of Clostridia Isolated from Gramineous Plants", Applied and Environmental Microbiology, May 2004, p. 3096-3102, vol. 70, No. 5.

Seghers, D., et al., "Impact of Agricultural Practices on the *Zea mays* L. Endophytic Community", Applied and Environmental Microbiology, Mar. 2004, p. 1475-1482, vol. 70, No. 3.

Bulgari, D., et al., "Endophytic Bacterial Diversity in Grapevine (*Vitis vinifera* L.) Leaves Described by 16S rRNA Gene Sequence Analysis and Length Beterogeneity-PCR", The Journal of Microbiology, Aug. 2009, p. 393-401, vol. 47, No. 4.

Amann, R., et al., "Single-cell identification in microbial communities by improved fluorescence in situ hybridization techniques", Nature Reviews Microbiology, 6: 339-348 (2008).

Chelius, M.K., et al., "The Diversity of Archaea and Bacteria in Association with the Roots of *Zea mays* L.", Microb Ecol (2001) 41:252-263.

Edwards, U., et al., "Isolation and direct complete nucleotide determination of entire genes. Characterization of a gene coding for 16S ribosomal RNA", Nucleic Acids Research 17: 7843-7853 (1989).

Prischl, M., et al., "Genetically modified Bt maize lines containing cry3Bb1, cry1A105 or cry1Ab2 do not affect the structure and functioning of root-associated endophyte communities", Applied Soil Ecology 54 (2012) 39-48.

Naveed, M., et al., "The endophyte *Enterobacter* sp. FD17: a maize growth enhancer selected based on rigorous testing of plant beneficial traits and colonization characteristics", Biol Fertil Soils (2014) 50:249-262.

Rashid, M., et al., "Inorganic polyphosphate is needed for swimming, swarming, and twitching motilities of Pseudomonas aeruginosa", PNAS vol. 97, No. 9, Apr. 25, 2000, pp. 4885-4890.

Mehta, S., et al., "An Efficient Method for Qualitative Screening of Phosphate-Solubilizing Bacteria", Current Microbiology vol. 43 (2001), pp. 51-56.

Dunn,R., et al., "Home Life: Factors Structuring the Bacterial Diversity Found within and between Homes", PLoS One, vol. 8, Issue 5, May 2013.

Massol-Deya, A., et al., "Bacterial community fingerprinting of amplified 16S and 16-23S ribosomal DNA gene sequences and restriction endonuclease analysis (ARDRA)", Molecular Microbial Ecology Manual 3.3.2: 1-8, 1995.

Extended European Search Report for Application No. 22190659,7, dated Feb. 10, 2023, 8 pages.

Allard, G. et al., "SPINGO: a rapid species-classifier for microbial amplicon sequences," BMC Bioinformatics, 2015, vol. 16, No. 324, 8 pages.

Anders, S. et al., "Differential expression analysis for sequence count data," Genome Biology, 2010, vol. 11, No. 11, pp. R106.

Ansari, M.A.; Brownbridge, M.; Shah, F.A.; Butt, T.M. Efficacy of entomopathogenic fungi against soil-dwelling life stages of western flower thrips, *Frankliniella occidentalis*, in plant-growing media. Entomol. Exp. Appl. 2008, 127, 80-87.

Asaff, A.; Cerda-Garcia-Rojas, C.; De la Torre, M. Isolation of dipicolinic acid as an insecticidal toxin from Paecilomyces fumosoroseus. Appl. Microbiol. Biotechnol. 2005, 68, 542-547.

BB-CBI, "*Beauveria bassiana* (white muscardine fungus)," Invasive Species Compendium, 2021, pp. 1-68.

Beris, E.I.; Papachristos, D.P.; Fytrou, A.; Antonatos, S.A.; Kontodimas, D.C. Pathogenicity of three entomopathogenic fungi on pupae and adults of the Mediterranean fruit fly, *Ceratitis capitata* (Diptera: Tephritidae). J. Pest Sci. 2013, 86, 275-284.

Chen, F. et al., "Assessing Performance of Orthology Detection Strategies Applied to Eukaryotic Genomes," PLoS ONE, Apr. 2007, No. 4, pp. e383.

Cole, J.R. et al., "Ribosomal Database Project: data and tools for high throughput rRNA analysis," Nucleic Acids Research, 2014, vol. 42, pp. D633-D642.

Deshpande, V. et al., "Fungal identification using a Bayesian classifier and the Warcup training set of internal transcribed spacer sequences," Mycologia, 2016, vol. 108, No. 1, pp. 1-5.

Djian, C. et al., Acetic acid: A selective nematicidal metabolite from culture filtrates of Paecilomyces lilacinus (Thom) Samson and Trichoderma longibrachiatum Rifai. Nematologica 1991, 37, 101-112.

Doster, M.A. et al., "Biocontrol of Aflatoxins in Figs," Proceedings of the Third International Symposium on Fig, 798, 2008, pp. 223-226.

Eberhardt, C. et al., "Proteomic Analysis of Kveim Reagent Identifies Targets of Cellular Immunity in Sarcoidosis," PLOS One, Jan. 23, 2017, vol. 12, No. 1, pp. 1-16.

Edgar, R.C., "UNOISE2: Improved Error-Correction For Illumina 16S and ITS Amplicon Sequncing," BioRxiv, 2016, No. 081257, 21 pages.

Ehteshamul-Haque, S. et al., "Biological control of root rot diseases of okra, sunflower, soybean and mungbean," Pakistan Journal of Botany, vol. 22, No. 2, Jun. 1990, pp. 121-124.

Enright, A.J. et al., "An efficient algorithm for large-scale detection of protein families," Nucleic Acids Research, 2002, vol. 30, No. 7, pp. 1575-1584.

Enright, A.J. et al., "Protein families and TRIBES in genome sequence space," Nucleic Acids Research, 2003, vol. 31, No. 15, pp. 4632-4638.

Faria, M.; Wraight, S.P. Biological control of Bemisia tabaci with fungi. Crop Prot. 2001, 20, 767-778.

Friedman, J. et al., "Regularization Path for Generalized Linear Models via Coordinate Descent," Journal of Statistical Software, 2010, vol. 33, No. 1, pp. 1-22.

Hoy, M.A.; Singh, R.; Rogers, M.E. Evaluations of a novel isolate of Isaria fumosorosea for control of the Asian citrus psyllid, *Diaphorina citri* (Hemiptera: Psyllidae). Fla. Entomol. 2010, 93, 24-32.

Kepenekci, I. et al., "Pathogenicity of the Entomopathogenic Fungus, *Purpureocillium lilacinum* TR1 Against the Black Cherry Aphid, *Myzus cerasi* Fabricus (Hemiptera: Aphididae)," Mun. Ent. Zool., vol. 10, No. 1, Jan. 2015, pp. 53-60.

Koljalg. U. et al., "Towards a unified paradigm for sequence-based identification of fungi," Molecular Ecology, 2013, vol. 22, pp. 5271-5277.

Kozich, J.J. et al., "Development of a Dual-Index Sequencing Strategy and Curation Pipeline for Analyzing Amplicon Sequence Data on the MiSeq Illumina Sequencing Platform," Applied and Environmental Microbiology, Sep. 2013, vol. 79, No. 17, pp. 5112-5120.

Li, W. et al., "Ultrafast clustering algorithms for metagenomic sequence analysis," Briefings in Bioinformatics, Nov. 1, 2012, vol. 13, No. 6., pp. 656-668.

McMurdie, P.J. et al., "Waste Not, Want Not: Why Rarefying Microbiome Data Is Inadmissible," PLOS Computational Biology, 2014, vol. 10, No. 4, pp. e1003531.

Mezeal, I.A.; Mizil, S.N.; Hussin, M.S. Researching biocontrol of Trichoderma viride, Paecilomyces lilacinus in contradiction of effectiveness of fungi insulated as of selected therapeutic herbals. Plant Arch. 2018, 18, 1631-1637.

NCBI, "Purpureocillium lilacinum," Taxonomy ID: 33203, 2021, three pages, [Online] [Retrieved on Feb. 27, 2021] Retrieved from the Internet <URL: https://www.ncbi.nlm.nih.gov/Taxonomy/Browser/wwwtax.cgi?id=33203>.

Needleman, S.B. et al., "A General Method Applicable to the Search for Similarities in the Amino Acid Sequence of Two Proteins," Journal Of Molecular Biology, 1970, vol. 28, No. 3, pp. 443-453.

O'Callaghan, M., "Microbial inoculation of seed for improved crop performance: issues and opportunities," Applied Microbiology and Biotechnology, vol. 100, May 2016, pp. 5729-5746.

Pandey, R. K. et al., "Effect of different bioformulations of Paecilomyces lilacinus against root-knot nematode (*Meloidogyne incognita*) infecting tomato (*Solanum esculentum*)," Indian Journal of Agricultural Sciences, vol. 81, No. 3, Mar. 2011, pp. 261-267.

(56) References Cited

OTHER PUBLICATIONS

Panyasiri, C.; Attathom, T.; Poehling, H.M. Pathogenicity of entomopathogenic fungi-potential candidates to control insect pests on tomato under protected cultivation in Thailand. J. Plant Dis. Prot. 2007, 114, 278-287.
Paul, N.C.; Deng, J.X.; Lee, J.H.; Yu, S.H. New records of endophytic Paecilomyces inflatus and Bionectria ochroleuca from chili pepper plants in Korea. Mycobiology 2013, 41, 18-24.
Perveen, Z.; Shahzad, S.A. Comparative study of the efficacy of *Paecilomyces* species against root-knot nematode Meloidogyne incognita. Pak. J. Nematol. 2013, 31, 125-131.
Piatkowski, J.; Krzyzewska, U.; Nawrot, U. Antifungal activity of enthomopathogenic species of the genus *Paecilomyces*. Mikol. Lek. 2003, 10, 93-99 (with abstract).
Quast, C. et al., "The SILVA ribosomal RNA gene database project: improved data processing and web-based tools," Nucleic Acids Research, 2013, vol. 41, pp. D590-D596.
Raafat, I. et al., "Nezara viridula (Hemiptera: Pentatomidae) Cuticle as a Barrier for *Beauveria bassiana* and *Paecilomyces* sp. Infection," African Entomology, vol. 23, Iss. 1, Mar. 2015, pp. 75-87.
Rajinikanth, R. et al., "Management of nematode induced disease complex in seedlings of cauliflower (*Brsassica pleraceae* var. *botrytis*) using bio-pesticides," Pest Management in Horticultural Ecosystems, vol. 19, No. 2, Dec. 2013, pp. 203-210.
Ratnalikar, K.K. et al., "Biological management of root-rot of cotton caused by Rhizoctonia bataticola," Indian Phytopathol. 44-45, Suppl., XV, 1993, pp. 1-2.
Rideout, J.R. et al., "Subsampled open-reference clustering creates consistent, comprehensive OTU definitions and scales to billions of sequences," PeerJ, 2014, 2:e545.
Roth, A.C.J. et al., "Algorithm of OMA for large-scale orthology inference," BMC Bioinformatics, 2008, vol. 9, pp. 518.
Shenoy, B.D. et al., "Impact of DNA sequence-data on the taxonomy of anamorphic fungi," Fungal Diversity, 2007, vol. 26, No. 10, pp. 1-54.
Shibuya, H. et al., "Transformation of Cinchona Alkaloids into 1-N-Oxide Derivatives by *Endophytic xylaria* sp. Isolated from Chinchona pubescens," Chem Pharm Bull, 2003, vol. 41, No. 1, pp. 71-74.
Singh, S. et al., "Bio-control activity of Purpureocillium lilacinum strains in managing root-knot disease of tomato caused by Meloidogyne incognita," Biocontrol Science and Technology, vol. 23, No. 12, Sep. 2013, pp. 1469-1489.
Sivakumar, T.; Eswaran, A.; Balabaskar, P. Bioefficacy of antagonists against for the management of *Fusarium oxysporum* f. sp. *lycopersici* and Meloidogyne incognita disease complex of tomato under field condition. Plant Arch. 2008, 8, 373-377 (with abstract).
Smith, T.F. et al., "Identification of Common Molecular Subsequences," Journal of Molecular Biology, 1981, vol. 147, pp. 195-197.
Spurgeon, D.W., "Efficacy of Beauveria bassiana Against Lygus hesperus (Hemiptera: Miridae) at Low Temperatures," Journal of Entomological Science, vol. 45, Iss. 3, Jul. 2010, pp. 211-219.
Sword, G. A et al., "Endophytic fungi alter sucking bug responses to cotton reproductive structures," Insect Science, vol. 24, Mar. 22, 2017, pp. 1003-1014.
Yeo, H.; Pell, J.K.; Alderson, P.G.; Clark, S.J.; Pye, B.J. Laboratory evaluation of temperature effects on the germination and growth of entomopathogenic fungi and on their pathogenicity to two aphid species. Pest Manag. Sci. 2003, 59, 156-165.
Zhang, X-Y. et al., "Diversity and Antimicrobial Activity of Culturable Fungi Isolated from Six Species of the South China Sea Gorgonians," Microbial Ecology, vol. 64, Apr. 2012, pp. 617-627.
Zhou, W. et al., "A fungal endophyte defensive symbiosis affects plant-nematode interactions in cotton," Plant Soil, vol. 422, Dec. 21, 2016, pp. 251-266.
Zuccaro, A., et al., "Endophytic Life Strategies Decoded by Genome and Transcriptome Analyses of the Mutualistic Root Symbiont *Piriformospora indica*," PLOS Pathogens, 2011, vol. 7, No. 10, e1002290.
Gaussian process model definition from towarddatascience.com downloaded May 15, 2023 (Year: 2023).
Gaussian process model definition from wikipedia.com, downloaded May 15, 2023 (Year: 2023).
Ghahramani, Z. (2013) Bayesian non-parametrics and the probabilistic approach to modeling. Philosophical transactions of the royal society A, vol. 371, 20110553, 20 pages.
Donahue, J. et al. Adversarial feature learning. arXiv: 1605. 09782V7, Apr. 3, 2017.
Database accession No. JQ759107, European Nucleotide Archive [Online] EMBL's European Bioinformatics Institute; Mar. 7, 2012, U'ren J M et al: "*Sordariomycetes* sp.genotype 60 isolate AK0688 internal transcribed spacer."
Database accession No. MG917011, European Nucleotide Archive [Online] EMBL's European Bioinformatics Institute; Feb. 21, 2019, Lagarde A. et al: "*Coniochaeta* sp.isolate Gir_07 internal transcribed spacer 1, partial sequence."
Database accession Nos. MZ267873, MZ267979, MZ267926, MZ267820; European Nucleotide Archive [Online] EMBL's European Bioinformatics Institute; Sep. 11, 2021, Arnold A E: "Coniochaeta nivea isolate LG0013 various submissions."
Database accession Nos. MZ267874, MZ267980, MZ267927, MZ267821; European Nucleotide Archive [Online] EMBL's European Bioinformatics Institute; Sep. 11, 2021, Arnold A E: "Coniochaeta nivea isolate LG0023."
Arnold, A. Elizabeth et al; "*Coniochaeta elegans* sp. nov., *Coniochaeta montana* sp. nov. and *Coniochaeta nivea* sp. nov., three new species of endophytes with distinctive morphology and functional traits", Int J Syst Evolu Microb vol. 71 No. 11, p. 5003.
Kokaew, J. et al; "Coniochaeta ligniaria an endophytic fungus from Baeckea frutescens and its antagonistic effects against plant pathogenic fungi", Thai Journal of Agricultural Science, vol. 44, Jun. 1, 2011, pp. 123-131.
Lagarde A. et al: "Antiproliferative and antibiofilm potentials of endolichenic fungi associated with the lichen *Nephroma laevigatum*", Journal of Applied Microbiology, vol. 126, No. 4, Jan. 30, 2019, pp. 1044-1058.
Nilsson et al; "Correspondence: Intraspecific ITS Variability in the Kingdom Fungi as Expressed in the International Sequence Databases and Its Implications for Molecular Species Identification", Evolutionary Bioinformatics, Jan. 1, 2008, pp. 193-201.
Trifonova, R. et al; "Interactions of plant-beneficial bacteria with the ascomycete *Coniochaeta ligniaria*", Journal of Applied Microbiology, vol. 106, No. 6, Jun. 1, 2009, pp. 1859-1866.
U'ren, Jana M., et al.; "Community Analysis Reveals Close Affinities Between Endophytic and Endolichenic Fungi in Mosses and Lichens", Microbial Ecology, vol. 60, No. 2, Jul. 13, 2010, pp. 340-353.
Shah, S., et al: "Colonization with non-mycorrhizal culturable endophytic fungi enhances orchid growth and indole acetic acid production", BMC Microbiology, vol. 22, No. 1, Jan. 1, 2022, pp. 1-13.
Albert, S. "Vegetable Seeds per Ounce/per Gram" Seed Starting—Harvest to Table, downloaded from the website http://www.harvesttotable.com/2011/05/vegetable_seeds_per_ounce_per/ on Mar. 27, 2017, 5 pages.
Castillo Lopez, D. et al. "The Entomopathogenic Fungal Endophytes *Purpureocillium lilacinum* (formerly Paecilomyces lilacinus) and Beauveria bassiana Negatively Affect Cotton Aphid Reproduction under Both Greenhouse and Field Conditions," PLOS ONE (2014) vol. 9, No. 8, e103891, pp. 1-8.
Fiedler, Z. et al. "Nematophagous fungus *Paecilomyces lilacinus* (Thom) Samson is also a biological agent for control of greenhouse insects and mite pests," BioControl (2007) vol. 52, pp. 547-558.
Giannantonio, et al. "Molecular characterizations of microbial communities fouling painted and unpainted concrete structures." International Biodeterioration & Biodegradation vol. 63,1 (2009):30-40.
Natsume, Y. "Gaussian Process Models: Simple Machine Learning Models Capable of Modelling Complex Behaviours," Towards Data Science (2021) downloaded May 17, 2023, 19 pages.
Yang,E.J. & Chang, H.C. "Bacillus subtilis strain MJP1 16S ribosomal RNA gene, partial sequence." GenBank Accession No. EU024822.1, deposited Jul. 10, 2007.

(56) References Cited

OTHER PUBLICATIONS

Ying,W. "Bacillus subtilis strain LC-4 16S ribosomal RNA gene, partial sequence." GenBank Accession No. GQ262726.1, deposited Jun. 11, 2009.

* cited by examiner

MARKERS OF PLANT HEALTH

CROSS REFERENCE TO RELATED APPLICATIONS

This application claims priority to Provisional Application Nos. 62/560,124, filed Sep. 18, 2017, and 62/651,033, filed Mar. 30, 2018, the disclosures of which are incorporated by reference in their entirety.

SEQUENCE LISTING

The instant application contains a Sequence Listing with 642 sequences which has been submitted via EFS-Web and is hereby incorporated by reference in its entirety. Said ASCII copy, created on Sep. 13, 2018, is named 41374_10102_Sequence_Listing.txt, and is 619,851 bytes in size.

FIELD OF THE INVENTION

This invention relates to methods for improving plant health.

BACKGROUND

According the United Nations Food and Agricultural Organization, the world's population will exceed 9.6 billion people by the year 2050, which will require significant improvements in agricultural to meet growing food demands. There is a need for improved agricultural plants that will meet the nearly doubled food production demands with fewer resources and more environmentally sustainable inputs, and for plants with improved responses to stresses.

Today, crop performance is optimized primarily via technologies directed towards the interplay between crop genotype (e.g., plant breeding, genetically modified crops) and its surrounding environment (e.g., fertilizer, synthetic herbicides, pesticides, biostimulants, and microbial treatments, in particular endophytes). A challenge to the development of these treatments is the considerable expense of testing the efficacy of new treatments in field trials. Effective markers of plant health, particularly markers which are detectable at early stages of development, would allow economical testing and selection of beneficial treatments.

SUMMARY OF INVENTION

In some embodiments, the invention described herein provides method for enriching a library of treatments, the method comprising at least the steps of: (a.) selecting plants from one or more treated populations and one or more reference populations, wherein one or more treatments from the library have been applied to the treated populations; (b.) profiling the microbial communities of the selected plants, and (c.) selecting one or more treatments where Alphaproteobacteria are enriched relative to Gammaproteobacteria in the microbial communities of treated plants compared to the microbial communities of reference plants, wherein the selected treatments comprise an enriched library of treatments capable of improving plant health.

In some embodiments, Alphaproteobacteria are enriched relative to Gammaproteobacteria when the log fold change of Alphaproteobacteria abundance relative to Gammaproteobacteria abundance is at least 1 in the microbial communities of treated plants. In some embodiments, the log fold change in abundance is a least 1.5. In some embodiments, the log fold change in abundance is a least 2. In some embodiments of any of the methods provided herein, Alphaproteobacteria are enriched relative to the combined abundance of Gammaproteobacteria and Betaproteobacteria. In some embodiments, the Order of the enriched Alphaproteobacteria are selected from the list consisting of: Rhizobiales, Sphingomonadales, Caulobacterales, and Rhodobacterales. In some embodiments, the Order of the enriched Alphaproteobacteria is Rhizobiales. In some embodiments, the Family of the enriched Alphaproteobacteria are selected from the list consisting of: Bradyrhizobiaceae, Sphingomonadaceae, Rhizobiaceae, Methylobacteriaceae, Caulobacteraceae, and Rhodobacteraceae. In some embodiments, the Family of the enriched Alphaproteobacteria is Bradyrhizobiaceae. In some embodiments, the Genera of the enriched Alphaproteobacteria are selected from the list consisting of: *Bradyrhizobium, Sphingomonas, Rhizobium, Methylobacterium, Phenylobacterium*, and *Novosphingobium*. In some embodiments, the Genera of the enriched Alphaproteobacteria is *Bradyrhizobium*. In some embodiments, at least one of the enriched Alphaproteobacteria comprise a nucleic acid sequence that is at least 97% identical to a nucleic acid sequence selected from the group consisting of SEQ ID NOs. 5-15, 198, 200, and 204. In some embodiments of any of the methods provided herein, the plants are dicots. In some embodiments of any of the methods provided herein, the plants are legumes. In some embodiments of any of the methods provided herein, the legume is soy (*Glycine max*).

In some embodiments, the invention described herein provides method for enriching a library of treatments, the method comprising at least the steps of: (a.) selecting plants from one or more treated populations and one or more reference populations, wherein one or more treatments from the library have been applied to the treated populations; (b.) profiling the microbial communities of the selected plants, and (c.) selecting one or more treatments where Dothideomycetes are enriched relative to Sordariomycetes in the microbial communities of treated plants compared to the microbial communities of reference plants, wherein the selected treatments comprise an enriched library of treatments capable of improving plant health.

In some embodiments, Dothideomycetes are enriched relative to Sordariomycetes when the log fold change of Dothideomycetes abundance relative to Sordariomycetes abundance is at least 0.5 in the microbial communities of treated plants. In some embodiments, the log fold change in abundance is a least 1. In some embodiments, the log fold change in abundance is a least 1.5. In some embodiments, the log fold change in abundance is a least 2. In some embodiments, the Order of the enriched Dothideomycetes are selected from the list consisting of: Pleosporales and Botryosphaeriales. In some embodiments, the Family of the enriched Dothideomycetes is Pleosporaceae, Leptosphaeriaceae, Phaeosphaeriaceae, and Botryosphaeriaceae. In some embodiments, the Genera of the enriched Dothideomycetes are selected from the list consisting of: *Cochliobolus, Leptosphaeria, Ophiosphaerella, Macrophomina, Phoma, Alternaria, Neosetophoma*, and *Epicoccum*. In some embodiments, at least one of the enriched Dothideomycetes comprise a nucleic acid sequence that is at least 97% identical to a nucleic acid sequence selected from the group consisting of SEQ ID NOs. 310, 315-332, 335-364, 367-377, 392-433, 460-474, 575-636.

In another aspect, the invention described herein provides synthetic compositions comprising a plant element and an endophyte that is heterologously disposed to the plant element, wherein said endophyte comprises a nucleic acid sequence that is at least 97% identical to a nucleic acid sequence selected from the group consisting of SEQ ID NOs. 5-15, 198, 200, and 204, wherein said endophyte is disposed in an amount effective to improve plant health as compared to a reference plant element not further comprising said endophyte.

In another aspect, the invention described herein provides synthetic compositions comprising a plant element and an endophyte that is heterologously disposed to the plant element, wherein said endophyte comprises a nucleic acid sequence that is at least 97% identical to a nucleic acid sequence selected from the group consisting of SEQ ID NOs. 310, 315-332, 335-364, 367-377, 392-433, 460-474, 575-636, wherein said endophyte is disposed in an amount effective to improve plant health as compared to a reference plant element not further comprising said endophyte. In another aspect, the invention described herein provides synthetic compositions comprising a plant element and an endophyte that is heterologously disposed to the plant element, wherein said endophyte comprises a nucleic acid sequence that is at least 97% identical to a nucleic acid sequence selected from the group consisting of SEQ ID NOs. 228-637, wherein said endophyte is disposed in an amount effective to improve plant health as compared to a reference plant element not further comprising said endophyte.

In some embodiments, the invention described herein provides a synthetic composition comprising a plant element and an endophyte that is heterologously disposed to the plant element, wherein said endophyte comprises a nucleic acid sequence that is at least 97% identical to a nucleic acid sequence selected from the group consisting of SEQ ID NOs. 5-15, 198, 200, and 204, wherein said endophyte is disposed in an amount effective to enrich the abundance of Alphaproteobacteria are relative to Gammaproteobacteria as compared to a reference plant element not further comprising said endophyte.

In some embodiments, the invention described herein provides a synthetic composition comprising a plant element and an endophyte treatment selected according to any of the methods provided herein, wherein the endophyte treatment is heterologously disposed to the plant element in an amount effective to improve plant health as compared to a reference plant element not further comprising said endophyte.

In some embodiments of any of the methods herein, the synthetic composition is applied in an effective amount to enrich the abundance of Alphaproteobacteria relative to the abundance of Gammaproteobacteria. In some embodiments, the synthetic composition is applied in an effective amount to enrich the abundance of Alphaproteobacteria relative to the combined abundance of Gammaproteobacteria and Betaproteobacteria. In some embodiments, the synthetic composition is applied in an effective amount to enrich the abundance of Dothideomycetes relative to the abundance of Sordariomycetes. In some embodiments, the synthetic composition is applied in an effective amount to enrich the abundance of one or more endophyte comprising a nucleic acid sequence selected from the group consisting of SEQ ID NOs. 5-15, 49-113, 198, 200, 203, 204, and 228-637.

In some embodiments of any of the synthetic compositions or methods provided herein, the plant element is a dicot. In some embodiments of any of the synthetic compositions or methods provided herein, the plant element is a legume. In some embodiments of any of the synthetic compositions or methods provided herein, the legume is soy.

In some embodiments, the invention described herein provides a synthetic composition comprising a treatment produced by the method comprising the steps of: (a.) selecting a treatment library; (b.) applying one or more treatments to a subset of similarly situated plants to create treated and reference populations; (c.) selecting plants from the treated and reference populations; (d.) profiling the microbial communities of the selected plants; (e.) enriching the treatment library by selecting one or more treatments where Alphaproteobacteria are enriched relative to Gammaproteobacteria in the microbial communities of the treated plants compared to the microbial communities of the reference plants; and (f) producing a treatment from one or more selected treatments of step (e.); wherein the treatment is capable of improving plant health.

In some embodiments, the invention described herein provides a synthetic composition comprising a treatment produced by the method comprising the steps of: (a.) selecting a treatment library; (b.) applying one or more treatments to a subset of similarly situated plants to create treated and reference populations; (c.) selecting plants from the treated and reference populations; (d.) profiling the microbial communities of the selected plants; (e.) enriching the treatment library by selecting one or more treatments where Dothideomycetes are enriched relative to Sordariomycetes in the microbial communities of the treated plants compared to the microbial communities of the reference plants; and (f.) producing a treatment from one or more selected treatments of step (e.); wherein the treatment is capable of improving plant health.

In some embodiments, the invention described herein provides a method of marketing a plant treatment comprising: (a.) contracting for the sale of a treatment to a customer, (b.) selecting plants from a treated and reference population on a customer's farm, (c.) profiling the microbial communities of the selected plants, and (d.) charging the customer an amount based on the enrichment of Alphaproteobacteria relative to Gammaproteobacteria in the microbial communities of the treated plants compared to the microbial communities of the reference plants.

In some embodiments, the invention described herein provides a method of marketing a plant treatment comprising: (a.) contracting for the sale of a treatment to a customer, (b.) selecting plants from a treated and reference population on a customer's farm, (c.) profiling the microbial communities of the selected plants, and (d.) recommending a treatment plan based on the enrichment of Alphaproteobacteria relative to Gammaproteobacteria in the microbial communities of the treated plants compared to the microbial communities of the reference plants.

In some embodiments, the invention described herein provides a method of marketing a plant treatment comprising: (a.) contracting for the sale of a treatment to a customer, (b.) selecting plants from a treated and reference population on a customer's farm, (c.) profiling the microbial communities of the selected plants, and (d.) charging the customer an amount based on the enrichment of Dothideomycetes relative to Sordariomycetes in the microbial communities of the treated plants compared to the microbial communities of the reference plants.

In some embodiments, the invention described herein provides a method of marketing a plant treatment comprising: (a.) contracting for the sale of a treatment to a customer, (b.) selecting plants from a treated and reference population on a customer's farm, (c.) profiling the microbial communities of the selected plants, and (d.) recommending a treatment plan based on the enrichment of Dothideomycetes relative to Sordariomycetes in the microbial communities of the treated plants compared to the microbial communities of the reference plants.

In some embodiments, the invention described herein provides a method of marketing a plant treatment comprising: (a.) contracting for the sale of a treatment to a customer, (b.) selecting plants from a treated and reference population on a customer's farm, (c.) profiling the microbial communities of the selected plants, and (d.) charging the customer an amount based on the increase in abundance in the profiled community of one or more endophytes comprising a nucleic acid sequence that is at least 97% identical to a nucleic acid sequence selected from the group consisting of SEQ ID NOs. 5-15, 49-113, 198, 200, 203, 204, 228-637. In some embodiments, the invention described herein provides a method of marketing a plant treatment comprising: (a.) contracting for the sale of a treatment to a customer, (b.) selecting plants from a treated and reference population on a customer's farm, (c.) profiling the microbial communities of the selected plants, and (d.) recommending a treatment plan based on the enrichment of increase in abundance in the profiled community of one or more endophytes comprising a nucleic acid sequence that is at least 97% identical to a nucleic acid sequence selected from the group consisting of SEQ ID NOs. 5-15, 49-113, 198, 200, 203, 204, 228-637.

In some embodiments, the invention described herein provides a method for enriching a library of treatments, the method comprising at least the steps of: (a.) selecting plants from one or more treated populations and one or more reference populations, wherein one or more treatments from the library have been applied to the treated populations; (b.) profiling the microbial communities of the selected plants, and (c.) selecting one or more treatments that increase the taxonomic diversity of the microbial communities of the treated plants compared to the microbial communities of the reference plants; wherein the selected treatments comprise a library enriched for treatments capable of improving plant health. In some embodiments, the average number of phyla detected in the microbial communities of treated plants is increased by at least 55% relative to the microbial communities of reference plants. In some embodiments, the taxonomic diversity comprises additional Phyla and the additional Phyla is Armatimonadetes. In some embodiments, the average number of Classes detected in the microbial community of treated plants is increased by at least 15% relative to reference plants. In some embodiments, the taxonomic diversity comprises additional Classes selected from the group consisting of Chthonomonadetes, TK10, Acidobacteria, Spartobacteria, Cyanobacteria, Acidobacteria_Gp6, and Deltaproteobacteria. In some embodiments, the method of selecting a treatment library further comprises an additional step of selecting treatments with reduced abundance of the Classes Chloroflexia or Verrucomicrobiae in the microbial communities of the treated plants compared to the microbial communities of the reference plants. In some embodiments, the average number of Orders detected in the microbial community of treated plants is increased by 5% relative to reference plants. In some embodiments, taxonomic diversity comprises additional Orders selected from the group consisting of C0119, Chthonomonadales, Legionellales, Subgroup_4, Chthoniobacterales, SubsectionIII, Gp6, and Myxococcales. In some embodiments, the method of selecting a treatment library further comprises an additional step of selecting treatments with reduced abundance of the Orders Verrucomicrobiales or Herpetosiphonales in the microbial communities of the treated plants compared to the microbial communities of the reference plants. In some embodiments, the average number of Families detected in the microbial community of treated plants is increased by at least 15% relative to reference plants. In some embodiments, taxonomic diversity comprises additional Families selected from the group consisting of Chthonomonadaceae, Legionellaceae, Alicyclobacillaceae, Paenibacillaceae, Chthoniobacteraceae, Nitrosomonadaceae, A0839, and Gp6. In some embodiments, the method of selecting a treatment library further comprises an additional step of selecting treatments with reduced abundance of the Families Verrucomicrobiaceae and Herpetosiphonaceae in the microbial communities of the treated plants compared to the microbial communities of the reference plants. In some embodiments, the number of Genera detected in the microbial community of treated plants is increased by at least 5% relative to reference plants. In some embodiments, the taxonomic diversity comprises additional Genera selected from the group consisting of *Chthonomonas*/Armatimonadetes_gp3, *Legionella, Blastocatella, Planctomyces, Tumebacillus, Ammoniphilus, Chthoniobacter, Sediminibacterium, Planktothrix* and Gp6. In some embodiments, the method of selecting a treatment library further comprises an additional step of selecting treatments with reduced abundance of the Genera *Agrobacterium, Verrucomicrobium, Simplicispira,* and *Herpetosiphon* in the microbial communities of the treated plants compared to the microbial communities of the reference plants. In some embodiments, taxonomic diversity comprises at least one endophyte comprising a nucleic acid sequence that is at least 97% identical to a nucleic acid sequence selected from the group consisting of SEQ ID NOs. 49-113, 203 and 204. In some embodiments of any of the methods of the present invention, the microbial communities of treated plants comprise nucleic acid sequences that are at least 97% identical to a nucleic acid sequence selected from the group consisting of SEQ ID NOs. 49-113, 203 and 204. In some embodiments, plants are monocots. In some embodiments, plants are cereals. In some embodiments, the cereal is corn.

In some embodiments, the invention provides a method for enriching a library of treatments, the method comprising at least the steps of: (a.) selecting plants from one or more treated populations and one or more reference populations, wherein one or more treatments from the library have been applied to the treated populations; (b.) profiling the microbial communities of the selected plants, and (c.) selecting one or more treatments where the profiled microbial communities of treated plants are enriched in one or more microbes comprising a nucleic acid sequence that is at least 97% identical to a nucleic acid sequence selected from the group consisting of SEQ ID NOs. 5-15, 49-113, 198, 200, 203, 204, 228-637 compared to the microbial communities of reference plants, wherein the selected treatments comprise an enriched library of treatments capable of improving plant health.

In some embodiments, the invention described herein provides a synthetic composition comprising a plant element and an endophyte comprising a nucleic acid sequence that is at least 97% identical to a SEQ ID listed in Table 3, wherein the endophyte is heterologously disposed to the plant element in an amount effective to increase the taxonomic diversity of the microbial community. In some embodiments, the taxonomic diversity comprises increased abundance of one or more endophytes comprising a nucleic acid sequence that is at least 97% identical to a SEQ ID listed in Table 3, wherein the endophytes that increase in abundance were not heterologously disposed to the plant element.

In some embodiments, the invention provides a synthetic composition comprising a plant element and an endophyte comprising a nucleic acid sequence that is at least 97% identical to a nucleic acid sequence selected from the group consisting of SEQ ID NOs. 5-15, 49-113, 198, 200, 203, 204, 228-637, wherein the endophyte treatment is heterologously disposed to the plant element in an amount effective to increase the abundance in the plant element or plant grown from the plant element, of one or more endophytes comprising a nucleic acid sequence that is at least 97% identical to a nucleic acid sequence selected from the group consisting of SEQ ID NOs. 5-15, 49-113, 198, 200, 203, 204, 228-637, wherein the one or more endophytes that increase in abundance were not heterologously disposed to the plant element.

In some embodiments, the invention described herein provides a synthetic composition comprising a plant element and an endophyte treatment selected according to the methods provided herein, wherein the endophyte treatment is heterologously disposed to the plant element in an amount effective to improve plant health as compared to a reference plant element not further comprising said endophyte.

In some embodiments, the invention described herein provides a synthetic composition comprising a treatment produced by the method comprising the steps of: (a.) selecting a treatment library; (b.) applying one or more treatments to a subset of similarly situated plants to create treated and reference populations; (c.) selecting plants from the treated and reference populations; (d.) profiling the microbial communities of the selected plants; (e.) enriching the treatment library by selecting one or more treatments that increase the taxonomic diversity of the microbial communities of the treated plants compared to the microbial communities of the reference plants; and (f) producing a treatment from one or more selected treatments of step (e.); wherein the treatment is capable of improving plant health.

In some embodiments, the invention provides a synthetic composition comprising a treatment produced by the method comprising the steps of: (a.) selecting a treatment library; (b.) applying one or more treatments to a subset of similarly situated plants to create treated and reference populations; (c.) selecting plants from the treated and reference populations; (d.) profiling the microbial communities of the selected plants; (e.) enriching the treatment library by selecting one or more treatments that increase the abundance in the profiled community of one or more endophytes comprising a nucleic acid sequence that is at least 97% identical to a nucleic acid sequence selected from the group consisting of SEQ ID NOs. 5-15, 49-113, 198, 200, 203, 204, 228-637 compared to the microbial communities of the reference plants; and (f.) producing a treatment from one or more selected treatments of step (e.); wherein the treatment is capable of improving plant health.

In some embodiments, the invention described herein provides a method of marketing a plant treatment comprising: (a.) contracting for the sale of a treatment to a customer, (b.) selecting plants from a treated and reference populations on a customer's farm, (c.) profiling the microbial communities of the selected plants, and (d.) charging the customer an amount based on an increase in the taxonomic diversity of the microbial communities of the treated plants compared to the microbial communities of the reference plants, wherein the taxonomic diversity comprises at least one endophyte comprising a nucleic acid sequence that is at least 97% identical to a SEQ ID listed in Table 3.

In some embodiments, the invention described herein provides a method of marketing a plant treatment comprising: (a.) contracting for the sale of a treatment to a customer, (b.) selecting plants from a treated and a reference population on a customer's farm, (c.) profiling the microbial communities of the selected plants, and (d.) recommending an agronomic activity based on an increase in the taxonomic diversity of the microbial communities of the treated plants compared to the microbial communities of the reference plants, wherein the taxonomic diversity comprises at least one endophyte comprising a nucleic acid sequence that is at least 97% identical to a SEQ ID listed in Table 3.

In some embodiments, the invention described herein provides a plurality of nucleic acid probes, wherein the plurality comprises reverse complementary sequences to contiguous 20 nucleotide regions of at least 10 nucleic acid sequences selected from the group consisting of SEQ ID NOs. 5-15, 49-113, 198, 200, 203, 204, 228-637. In some embodiments, the plurality of nucleic acid probes comprise reverse complementary sequences to contiguous 20 nucleotide regions of at least 50 nucleic acid sequences selected from the group consisting of SEQ ID NOs. 5-15, 49-113, 198, 200, 203, 204, 228-637. In some embodiments, the invention described herein provides a plurality of nucleic acid probes, wherein the plurality comprises complementary sequences to contiguous 20 nucleotide regions of at least 10 nucleic acid sequences selected from the group consisting of SEQ ID NOs. 5-15, 49-113, 198, 200, 203, 204, 228-637. In some embodiments, the plurality of nucleic acid probes comprise complementary sequences to contiguous 20 nucleotide regions of at least 50 nucleic acid sequences selected from the group consisting of SEQ ID NOs. 5-15, 49-113, 198, 200, 203, 204, 228-637. In some embodiments of any of the pluralities of nucleic acid probes described herein, the nucleic acid sequences are selected from the group consisting of SEQ ID NOs: 6, 7, 8, 9, 10, 50, 65, and combinations thereof. In some embodiments, the invention described herein provides a plurality of nucleic acid probes, wherein there is at least one probe in the plurality that is complementary or reverse-complementary to the nucleic acid sequences SEQ ID NOs: 6, 7, 8, 9, 10, 50, 65, 253, 254, 273, 277, 511-529, and 546. In some embodiments, the invention described herein provides a plurality of nucleic acid probes, wherein there is at least one probe in the plurality capable of hybridizing to the nucleic acid sequences SEQ ID NOs: 6, 7, 8, 9, 10, 50, 65, 253, 254, 273, 277, 511-529, and 546. In some embodiments of any of the pluralities of nucleic acid probes described herein, the nucleic acid sequences are selected from the group consisting of SEQ ID NOs: 228-637, and combinations thereof. In some embodiments, the invention described herein provides a plurality of nucleic acid probes, wherein there is at least one probe in the plurality that is complementary or reverse-complementary to the nucleic acid sequences SEQ ID NOs: 228-637. In some embodiments, the invention described herein provides a plurality of nucleic acid probes, wherein there is at least one probe in the plurality capable of hybridizing to the nucleic acid sequences SEQ ID NOs: 6, 7, 8, 9, 10, 50, 65, 253, 254, 273, 277, 511-529, and 546. In some embodiments, the probes are capable of hybridizing under stringent conditions. In some embodiments, the nucleic acid probes are single-stranded DNA. In some embodiments, the nucleic acid probes are attached to one or more solid supports. In some embodiments, the nucleic acid probes are attached to a plurality of beads. In some embodiments, the nucleic acid probes are attached to a contiguous solid support. In some embodiments, the invention described herein provides a nucleic acid detection kit comprising any of the plurality of nucleic acid probes described herein.

In some embodiments, the invention described herein provides a method for enriching a library of plants, the method comprising at least the steps of: (a.) selecting a plurality of plants from the library of plants; (b.) applying a treatment to a subset of the plants to create a treated population and a reference population for each plant variety; (c.) applying an endophyte composition comprising one or more endophytes to the treated and reference populations; (d.) selecting plants from one or more treated populations and one or more reference populations; (e.) profiling the microbial communities of the selected plants, and (f.) selecting the plants wherein the microbial communities of the treated plants are enriched in the endophytes applied in step (b.) compared to the microbial communities of the reference plants; wherein the selected plants comprise an enriched library of plants capable of being improved by a treatment. In some embodiments, the steps (a.)(f.) are repeated with the selected plants. In some embodiments, the library of plants comprises plants of different species. In some embodiments, the library of plants comprises plants of the same species. In some embodiments, the library of plants comprises modified plants. In some embodiments, the library of plants comprises plants that different varieties of the same species.

In some embodiments, the invention described herein provides a method for enriching a library of treatments, the method comprising at least the steps of: (a.) applying a treatment to a subset of plants to create a treated population and a reference population; (b.) applying an endophyte composition comprising one or more endophytes to the treated and reference populations; (c.) selecting plants from one or more treated populations and one or more reference populations, (d.) profiling the microbial communities of the selected plants, and (e.) selecting the treatments, wherein the microbial communities of the treated plants are enriched in the endophytes applied in step (b.) compared to the microbial communities of the reference plants; wherein the selected treatments comprise an enriched library of treatments capable of improving plant health. In some embodiments, the steps (a.)-(e.) are repeated with the selected treatments.

In some embodiments of any of the methods or compositions provided herein, the endophyte composition comprises one or more endophytes selected from the endophytes in Table 1. In some embodiments of any of the methods or compositions provided herein, the endophyte composition comprises one or more endophytes selected from the endophytes in Table 3. In some embodiments of any of the methods or compositions provided herein, the endophyte composition comprises one or more endophytes selected from the endophytes in Table 15. In some embodiments, the endophyte composition comprises one or more endophytes of the Order Rhizobiales. In some embodiments, the endophyte composition comprises one or more endophytes of the Family Bradyrhizobiaceae. In some embodiments, the endophyte composition comprises one or more endophytes of the Genus *Bradyrhizobium*. In some embodiments, the endophyte composition comprises one or more endophytes comprising a nucleic acid sequence that is at least 97% identical to a nucleic acid sequence selected from the group consisting of SEQ ID NOs: 6, 7, 8, 9, 10, 50, 65, 253, 254, 273, 277, 511-529, and 546.

In some embodiments of any of the methods or compositions provided herein, a treatment comprises one or more endophytes. In some embodiments, a treatment comprises two or more endophytes.

In some embodiments of any of the methods or compositions provided herein, profiling a microbial community comprises sequencing of RNA transcripts, sequencing of marker genes, metagenome sequencing, metabolomics analysis, proteomic analysis, enzyme activity, phospholipid fatty acid analysis, volatile organic compound analysis, exudate analysis, and phytohormone analysis. In some embodiments, the profiling of the microbial community is sequencing of marker genes. In some embodiments of any of the methods or compositions provided herein, plants in treated and reference populations had been subjected to an environmental stress. In some embodiments of methods provided herein, the steps of selecting plants, profiling microbial communities, and selecting treatments or plants are repeated with the selected treatments or plants.

BRIEF DESCRIPTION OF THE DRAWINGS

FIG. 5 shows the alpha diversity of soy plants at various stages.

FIG. 8A shows the log ratio values for plants whose microbial communities were profiled at the V1 stage. FIG. 8B shows the log ratio values for plants whose microbial communities were profiled at the V2 stage. The communities were profiled by 16S sequencing as described in Example 2.

DETAILED DESCRIPTION

Figure 1:
FIG. 1 represents exemplary corn plants, showing a corn plant that is larger and more robust (left) compared to a corn plant that is smaller, less green and less vibrant (right).

Terms used in the claims and specification are defined as set forth below unless otherwise specified.

It must be noted that, as used in the specification and the appended claims, the singular forms "a," "an" and "the" include plural referents unless the context clearly dictates otherwise.

This invention relates to methods and compositions for improving plant health. The present invention includes methods for making an enriched library of treatments capable of improving plant health, methods for an making an enriched library of plants capable of being improved by a treatment, and methods of marketing a plant treatment, as well as synthetic compositions comprising treatments produced by the methods of the present invention, synthetic compositions comprising endophytes capable of improving plant health, and nucleic acid probes and nucleic acid detection kits that may be used in the methods of the present invention.

"Plant health" is demonstrated by the improvement of a trait of agronomic importance in a plant or plant element as compared to a reference plant or plant element. A trait of agronomic importance include, but are not limited to disease resistance, drought tolerance, heat tolerance, cold tolerance, salinity tolerance, metal tolerance, herbicide tolerance, improved water use efficiency, improved nitrogen utilization, improved nitrogen fixation, pest resistance, herbivore resistance, pathogen resistance, yield improvement, health enhancement, vigor improvement, growth improvement, photosynthetic capability improvement, nutrition enhancement, altered protein content, altered oil content, increased biomass, increased shoot length, increased root length, increased root biomass, increased root area, improved root architecture, modulation of a metabolite, modulation of the proteome, increased seed weight, altered seed carbohydrate composition, altered seed oil composition, altered seed protein composition, altered seed nutrient composition, and combinations thereof. Increased tolerance or resistance, for example disease resistance, drought tolerance, heat tolerance, etc., can be assessed by measuring modulation of physiological parameters including, but not limited to, plant height, plant biomass, root and/or shoot biomass, seed germination, seedling survival, photosynthetic efficiency, transpiration rate, seed/fruit number or mass, plant grain or fruit yield, leaf chlorophyll content, photosynthetic rate, root length, wilt recovery, turgor pressure, area affected by herbivory, area of necrotic tissue, or area or degress of chlorosis, or any combination thereof, as compared to a reference plant grown under similar conditions.

"Biomass" means the total mass or weight (fresh or dry), at a given time, of a plant tissue, plant tissues, an entire plant, or population of plants. The term may also refer to all the plants or species in the community (community biomass).

An "increased yield" can refer to any increase in seed or fruit biomass, or seed or fruit number per plant, or seed or fruit weight, or seed or fruit size per plant or unit of production area, e.g. acre or hectare. For example, increased yield of seed or fruit biomass may be measured in units of bushels per acre, pounds per acre, tons per acre, or kilo per hectare. An increased yield can also refer to an increase production of a component of, or product derived from, a plant or plant element or of unit of measure thereof. For example, increased carbohydrate yield of a grain or increased oil yield of a seed. Typically, the where yield indicates an increase in a particular component or product derived from a plant, the particular characteristic is designated when referring to increased yield, e.g., increased oil or grain yield or increased protein yield or seed size.

"Nutrient" or "seed nutrient" refers to any composition of the associated plant element, most particularly compositions providing benefit to other organisms that consume or utilize said plant element.

In some embodiments, one or more treatments are heterologously disposed on a plant element in an amount effective to improve plant health. In some embodiments, an improvement of plant health is measured by an increase in a trait of agronomic importance, for example increased root length or increased yield. In some embodiments, an improvement in plant health is measured by a decrease in a trait of agronomic importance, for example a decrease area of necrosis or reduced chlorosis. Plant treatments described herein may improve plant health by providing an improved benefit or tolerance to a plant that is of at least 0.1%, at least 0.5%, at least 1%, at least 2%, at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, when compared with a reference plant. A "reference plant", "reference plant element", "reference agricultural plant" or "reference seed" a similarly situated plant or seed of the same species, strain, or cultivar to which a treatment, formulation, composition or endophyte preparation as described herein is not administered/contacted. A reference plant, therefore, is identical to the treated plant except for the presence of the active ingredient to be tested and can serve as a control for detecting the effects of the treatment conferred to the plant. A plurality of reference plants may be referred to as a "reference population".

The methods and compositions of the present invention are broadly applicable to cultivated plants, particularly plants that are cultivated by humans for food, feed, fiber, fuel, and/or industrial purposes. In some embodiments, plants (including seeds and other plant elements) are monocots or dicots. In some embodiments, plants used in the methods and compositions of the present invention include, but are not limited to: agricultural row, agricultural grass plants or other field crops: wheat, rice, barley, buckwheat, beans (soybean, snap, dry), corn (grain, seed, sweet corn, silage, popcorn, high oil), canola, peas (dry, succulent), peanuts, safflower, sunflower, alfalfa hay, forage crops (alfalfa, clover, vetch, and trefoil), berries and small fruits (blackberries, blueberries, currants, elderberries, gooseberries, huckleberries, loganberries, raspberries, strawberries, bananas and grapes), bulb crops (garlic, leeks, onions, shallots, and ornamental bulbs), citrus fruits (citrus hybrids, grapefruit, kumquat, lines, oranges, and pummelos), cucurbit vegetables (cucumbers, melons, gourds, pumpkins, and squash), flowers, bedding plants, ornamentals, fruiting vegetables (eggplant, sweet and hot peppers, tomatillos, and tomatoes), herbs, spices, mints, hydroponic crops (cucumbers, tomatoes, lettuce, herbs, and spices), leafy vegetables and cole crops (arugula, celery, chervil, endive, fennel, lettuce (head and leaf), parsley, radicchio, rhubarb, spinach, Swiss chard, broccoli, Brussels sprouts, cabbage, cauliflower, collards, kale, kohlrabi, and mustard greens), asparagus, legume vegetable and field crops (snap and dry beans, lentils, succulent and dry peas, and peanuts), pome fruit (pears and quince), root crops (beets, sugarbeets, red beets, carrots, celeriac, chicory, horseradish, parsnip, radish rutabaga, salsify, and turnips), deciduous trees (maple and oak), pine, small grains (rye, wheat, millet, stone fruits (apricots, cherries, nectarines, peaches, plums, and prunes), tree nuts (almonds, beech nuts, Brazil nuts, butternuts, cashews, chestnuts, filberts, hickory nuts, macadamia nuts, pecans, pistachios, and walnuts), and tuber crops (potatoes, sweet potatoes, yams, artichoke, cassava, and ginger). In a particular embodiment, the agricultural plant is selected from the group consisting of rice (*Oryza sativa* and related varieties), soy (*Glycine max* and related varieties), wheat (*Triticum aestivum* and related varieties), corn (*Zea mays* and related varieties), peanuts (*Arachis hypogaea* and related varieties), canola (*Brassica napus, Brassica rapa* and related varieties), coffee (*Coffea* spp.), cocoa (*Theobroma cacao*), melons, and tomatoes (*Solanum lycopsersicum* and related varieties).

Plant health may be improved by treatment of a plant or plant element. A "plant element" is intended to generically reference either a whole plant or a plant component, including but not limited to plant tissues, parts, and cell types. A plant element is preferably one of the following: whole plant, seedling, meristematic tissue, ground tissue, vascular tissue, dermal tissue, seed, leaf, root, shoot, stem, flower, fruit, stolon, bulb, tuber, corm, keikis, shoot, bud.

Plant health may be improved by treatment with a composition of the present invention, in particularly compositions of the present invention comprising endophytes, or by application of other treatments such as a biostimulants, fungicides, biocides (anti-complex agents), herbicides, insecticides, nematicides, rodenticides, bactericides, virucides, fertilizers, and other agents.

An "endophyte" is an organism capable of living on a plant element (e.g., rhizoplane or phylosphere) or within a plant element, or on a surface in close physical proximity with a plant element, e.g., the rhizosphere and surrounding soil. A "beneficial" endophytes does not cause disease or harm the host plant otherwise. Endophytes can occupy the intracellular or extracellular spaces of plant tissue, including the leaves, stems, flowers, fruits, seeds, or roots. An endophyte can be, for example, a bacterial or fungal organism, and can confer a beneficial property to the host plant such as an increase in yield, biomass, resistance, or fitness. An endophyte can be a fungus or a bacterium. As used herein, the term "microbe" is sometimes used to describe an endophyte. As used herein, the term "microbe" or "microorganism" refers to any species or taxon of microorganism, including, but not limited to, archaea, bacteria, microalgae, fungi (including mold and yeast species), mycoplasmas, microspores, nanobacteria, oomycetes, and protozoa. In some embodiments, a microbe or microorganism is an endophyte, for example a bacterial or fungal endophyte, which is capable of living within a plant.

As used herein, the term "bacterium" or "bacteria" refers in general to any prokaryotic organism, and may reference an organism from either Kingdom Eubacteria (Bacteria), Kingdom Archaebacteria (Archae), or both. In some cases, bacterial genera have been reassigned due to various reasons (such as, but not limited to, the evolving field of whole genome sequencing), and it is understood that such nomenclature reassignments are within the scope of any claimed genus. As used herein, the term "fungus" or "fungi" refers in general to any organism from Kingdom Fungi. Historical taxonomic classification of fungi has been according to morphological presentation. Beginning in the mid-1800's, it was recognized that some fungi have a pleomorphic life cycle, and that different nomenclature designations were being used for different forms of the same fungus. With the development of genomic sequencing, it became evident that taxonomic classification based on molecular phylogenetics did not align with morphological-based nomenclature (Shenoy B D, Jeewon R, Hyde K D. Impact of DNA sequence-data on the taxonomy of anamorphic fungi. Fungal Diversity 26(10) 1-54. 2007). Systematics experts have not aligned on common nomenclature for all fungi, nor are all existing databases and information resources inclusive of updated taxonomies. As such, many fungi referenced herein may be described by their anamorph form but it is understood that based on identical genomic sequencing, any pleomorphic state of that fungus may be considered to be the same organism. In some cases, fungal genera have been reassigned due to various reasons, and it is understood that such nomenclature reassignments are within the scope of any claimed genus.

The degree of relatedness between microbes may be inferred from the sequence similarity of one or more homologous polynucleotide sequences of the microbes. In some embodiments, the one or more homologous polynucleotide sequences are marker genes. As used herein, the term "marker gene" refers to a conserved genomic region comprising sequence variation among related organisms. Examples of marker genes that may be used for the present invention, include but are not limited to: 16S ribosomal RNA ("16S"); internal transcribed spacer ("ITS"); fusA gene; largest subunit of RNA polymerase II ("RPB1"); second largest subunit of RNA polymerase II ("RPB2"); beta-tubulin ("BTUB2"); phosphoglycerate kinase ("PGK"); actin ("ACT"); long subunit rRNA gene ("LSU"); small subunit rRNA gene ("SSU").

The terms "sequence similarity", "identity", "percent identity", "percent sequence identity" or "identical" in the context of polynucleotide sequences refer to the nucleotides in the two sequences that are the same when aligned for maximum correspondence. There are different algorithms known in the art that can be used to measure nucleotide sequence identity. Nucleotide sequence identity can be measured by a local or global alignment, preferably implementing an optimal local or optimal global alignment algorithm. For example, a global alignment may be generated using an implementation of the Needleman-Wunsch algorithm (Needleman, S. B. & Wunsch, C. D. (1970) Journal of Molecular Biology. 48(3):443-53). For example, a local alignment may be generated using an implementation of the Smith-Waterman algorithm (Smith T. F & Waterman, M. S. (1981) Journal of Molecular Biology. 147(1):195-197). Optimal global alignments using the Needleman-Wunsch algorithm and optimal local alignments using the Smith-Waterman algorithm are implemented in USEARCH, for example USEARCH version v8.1.1756_i86osx32.

A gap is a region of an alignment wherein a sequence does not align to a position in the other sequence of the alignment. In global alignments, other than whole genome alignments, terminal gaps are discarded before identity is calculated. For both local and global alignments, internal gaps are counted as differences. A terminal gap is a region beginning at the end of a sequence in an alignment wherein the nucleotide in the terminal position of that sequence does not correspond to a nucleotide position in the other sequence of the alignment and extending for all contiguous positions in that sequence wherein the nucleotides of that sequence do not correspond to a nucleotide position in the other sequence of the alignment. An internal gap is a gap in an alignment which is flanked on the 3' and 5' end by positions wherein the aligned sequences are identical.

In some embodiments, the nucleic acid sequence to be aligned is a complete gene. In some embodiments, the nucleic acid sequence to be aligned is a gene fragment. In some embodiments, the nucleic acid sequence to be aligned is an intergenic sequence. In a preferred embodiment, inference of homology from a sequence alignment is make where the region of alignment is at least 85% of the length of the query sequence.

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, at least 97%, 98%, 99% or 100% of the positions of the alignment, wherein the region of alignment is at least about 50%, 60%, 70%, 75%, 85%, or at least about 90%, or at least about 95%, 96%, 97%, 98%, 99% or 100% of the length of the query sequence. In a preferred embodiment, the region of alignment contains at least 100 positions inclusive of any internal gaps. In some embodiments, the region of alignment comprises at least 100 nucleotides of the query sequence. In some embodiments, the region of alignment comprises at least 200 nucleotides of the query sequence. In some embodiments, the region of alignment comprises at least 300 nucleotides of the query sequence. In some embodiments, the region of alignment comprises at least 400 nucleotides of the query sequence. In some embodiments, the region of alignment comprises at least 500 nucleotides of the query sequence. In some embodiments, the terminal nucleotides are trimmed from one or both ends of the sequence prior to alignment. In some embodiments, the terminal nucleotides are trimmed from one or both ends of the sequence prior to alignment in order to remove primer or vector sequences. In some embodiments, at least the terminal 10, 15, 20, 25, 30, between 20-30, 35, 40, 45, 50, between 25-50 nucleotides are trimmed from the sequence prior to alignment.

Methods of Enriching Treatment and Plant Libraries

A particular challenge for the modern agriculture industry is the high cost of testing the efficacy of treatments to improve plant health and selecting the plants and plant varieties on which those treatments are most effective. Testing often requires growing plants to maturity, which for many crops limits testing to one growing season per year. Methods of the present invention allow for testing of the efficacy of treatments shortly after plants have been treated. For example, methods of the present invention may be used to score the efficacy of treatments within 1, 2, 3, or 4 weeks of treatment. It is desirable to develop many possible treatments and screen them against many plants and plant varieties and many environmental conditions in an iterative manner during the development process. The scope of the desired level of testing can be prohibitive, however, as the cost of developing commercial agricultural treatments can be considerable, more than $130 million per treatment.

The collection of many treatments to be tested for their efficacy or ability to improve plant health is a "library of treatments" or "treatment library". The methods of the present invention reduce product development costs allowing for the rapid and efficient selection of treatments within the treatment library which have the highest probability of success in improving plant health. The selection of these high efficacy treatments results in an enriched treatment library, a collection of treatments that on average have a higher probability of success than the initial treatment library. The enrichment of the library allows money spent on further testing, manufacturing compatibility assays, and regulatory activities to be effectively directed towards development of the most promising treatments. Similarly, the efficacy of many treatments is related to the species of plant or plant variety or modified plant. The collection of many plants to be tested for their efficacy or ability to improve plant health is a "library of plants" or "plant library". The methods of the present invention reduce product development costs allowing for the rapid and efficient selection of plant varieties within the plant library which have the highest probability of success in improving plant health in combination with a treatment. The selection of these high efficacy plants results in an enriched plant library, a collection of plants that on average have a higher probability of proving plant health in combination with the applied treatment than the initial plant library. The enrichment of treatment and plant libraries allows money spent on further testing, manufacturing compatibility assays, and regulatory activities to be effectively directed towards development of the most promising treatments and treatment plant combinations.

In some embodiments, a treatment may comprise a modified microbe or plant or plant element. A microbe or plant or plant element is "modified" when it comprises an artificially introduced genetic or epigenetic modification. In some embodiments, the modification is introduced by a genome engineering technology. In some embodiments, the modification is introduced by a targeted nuclease. In some embodiments, targeted nucleases include, but are not limited to, transcription activator-like effector nuclease (TALEN), zinc finger nuclease (ZNF), clustered regulatory interspaced short palindromic repeats (CRISPR), CRISPR/Cas9, CRISPR/CPF1, and combinations thereof. In some embodiments, the modification is an epigenetic modification. In some embodiments, the modification is introduced by treatment with a DNA methyltransferase inhibitor such as 5-azacytidine, or a histone deacetylase inhibitor such as 2-amino-7-methoxy-3H-phenoxazin-3-one. In some embodiments, the modification is introduced via tissue culture. In some embodiments, a modified microbe or plant or plant element comprises a transgene.

In some embodiments, a treatment is applied to a plant or plant element by heterologously disposing the treatment to the plant or plant element. A treatment is "heterologously disposed" when mechanically or manually applied, artificially inoculated or disposed onto or into a plant element, seedling, plant or onto or into a plant growth medium or onto or into a treatment formulation so that the treatment exists on or in the plant element, seedling, plant, plant growth medium, or formulation in a manner not found in nature prior to the application of the treatment, e.g., said combination which is not found in nature in that plant variety, at that time in development, in that tissue, in that abundance, or in that growth condition (for example drought).

In some embodiments, a treatment is applied mechanically or manually or artificially inoculated to a plant element in a seed treatment, root wash, seedling soak, foliar application, soil inocula, in-furrow application, side dress application, soil pre-treatment, wound inoculation, drip tape irrigation, vector-mediation via a pollinator, injection, osmopriming, hydroponics, aquaponics, aeroponics, and combinations thereof. Application to the plant may be achieved, for example, as a powder for surface deposition onto plant leaves, as a spray to the whole plant or selected plant element, as part of a drip to the soil or the roots, or as a coating onto the plant element prior to or after planting. Such examples are meant to be illustrative and not limiting to the scope of the invention.

In some embodiments of the methods described herein, the plants of the treated or reference populations of plants or both the treated and reference populations of plants are selected. The selection of plants may also be referred to as sampling or harvesting. In a preferred embodiment, more than one plant is selected from each of the treatment and reference populations and the selected plants are individually prepared for profiling. In some embodiments, more than one tissue sample is collected from each plant selected.

In some embodiments of the methods described herein, the plants of the treated or reference populations of plants or both the treated and reference populations of plants are subjected to a stress condition. In some embodiments, the plants of the treated or reference populations of plants or both the treated and reference populations of plants had previously been subjected to a stress condition. In some embodiments, the plants previously subjected to a stress condition are allowed to recover prior to their selection for profiling. In any of the methods for enriching a library of treatments, the plants selected from the treated or reference populations or both the treated and reference populations are subjected to a stress condition after they are selected for profiling. In some embodiments of any of the methods described herein, the stress condition is a biotic or abiotic stress, or a combination of one or more biotic or abiotic stresses. In some embodiments of any of the methods described herein, the stress condition is an abiotic stress selected from the group consisting of: drought stress, salt stress, metal stress, heat stress, cold stress, low nutrient stress, and excess water stress, and combinations thereof. In some embodiments of any of the methods described herein, the stress condition is drought stress. In some embodiments of any of the methods described herein, the stress condition is a biotic stress selected from the group consisting of: insect infestation, nematode infestation, complex infection, fungal infection, bacterial infection, oomycete infection, protozoal infection, viral infection, herbivore grazing, and combinations thereof.

In some embodiments of any of the methods described herein, the microbial communities of treated and reference plants are profiled. The entire plant or plant elements, surfaces or surrounding compositions may be profiled, including but not limited to: whole plant, seedling, meristematic tissue, ground tissue, vascular tissue, dermal tissue, seed, leaf, root, shoot, stem, flower, fruit, stolon, bulb, tuber, corm, keikis, shoot, bud, rhizoplane, phylosphere, surface sterilized plant tissue, washes of plant surfaces, the rhizosphere, surrounding soil and combinations thereof. Various methods for profiling the microbial community may be used including, but not limited to: sequencing of RNA transcripts, sequencing of marker genes, copy number variation analysis, single nucleotide polymorphism analysis, metagenome sequencing, metabolomics analysis, proteomic analysis, enzyme activity, phospholipid fatty acid analysis, volatile organic compound analysis, exudate analysis, and phytohormone analysis. As used herein, the term "marker gene" refers to a conserved genomic region comprising sequence variation among related organisms. Examples of marker genes that may be used for the present invention, include but are not limited to: 16S ribosomal RNA ("16S"); internal transcribed spacer ("ITS"); fusA gene; largest subunit of RNA polymerase II ("RPB1"); second largest subunit of RNA polymerase II ("RPB2"); beta-tubulin ("BTUB2"); phosphoglycerate kinase ("PGK"); and actin ("ACT"); long subunit rRNA gene ("LSU"); small subunit rRNA gene ("SSU"). In some embodiments, the microbial communities of treated and reference plants are correlated with a molecular phenotype of the plant. In some aspects profiling the plant's molecular phenotype is a proxy for its microbial community composition, and as such, in some embodiments profiling a microbe-associated plant molecular phenotype is a method of profiling the microbial community. In some embodiments, profiling the microbial community may be done by profiling only one or more direct measures of the microbial community, such as a microbe molecular phenotype (for example 16S marker gene sequencing); by profiling only one or more microbe-associated plant molecular phenotypes, such as the expression of a plant gene induced by a beneficial microbe; or by profiling both one or more direct measures of a microbe and one or more microbe-associated plant molecular phenotypes. A "molecular phenotype" is any molecular or chemical characterization of an organism's composition or production. As a non-limiting example, a molecular phenotype includes, but is not limited to, sequencing of RNA transcripts, sequencing of genomic regions (for example marker genes, and including determination of epigenetic modifications), determining the abundance of a polynucleotide sequence (for example by qPCR), copy number variation analysis, single nucleotide polymorphism analysis, metagenome sequencing, metabolomics analysis, proteomic analysis (including determination of one or more post-translational modifications), enzyme activity, phospholipid fatty acid analysis, volatile organic compound analysis, exudate analysis, and phytohormone analysis.

In some embodiments of methods of the present invention, a treatment library is enriched by selecting one or more treatments where Alphaproteobacteria are enriched relative to Gammaproteobacteria in the microbial communities of treated plants compared to the microbial communities of reference plants. In some embodiments, Alphaproteobacteria are enriched relative to the combined abundance of Gammaproteobacteria and Betaproteobacteria. In some embodiments, the treatment library is enriched by selecting one or more treatments where the average abundance of Alphaproteobacteria relative to Gammaproteobacteria in the microbial communities of treated plants is increased compared to the average abundance of Alphaproteobacteria relative to Gammaproteobacteria in the microbial communities of reference plants. In some embodiments, the abundance of Alphaproteobacteria is increased and the abundance of Gammaproteobacteria and Betaproteobacteria is decreased in the microbial communities of treated plants. In some embodiments, the log fold change of Alphaproteobacteria abundance relative to Gammaproteobacteria abundance in the microbial communities of treated plants is at least 0.1, at least 0.5, at least 1, between 0.5 and 1.5, at least 1.5, between 1 and 2, at least 2. Log fold change is calculated by taking the log base 2 of the ratio of the average abundance of Alphaproteobacteria to the average abundance of Gammaproteobacteria. In some embodiments, the abundance of endophytes of the following taxonomic categorizations are increased in in the microbial communities of treated plants relative to the microbial communities of reference plants: Rhizobiales, Sphingomonadales, Caulobacterales, Rhodobacterales, Bradyrhizobiaceae, Sphingomonadaceae, Rhizobiaceae, Methylobacteriaceae, Caulobacteraceae, Rhodobacteraceae, *Bradyrhizobium, Sphingomonas, Rhizobium, Methylobacterium, Phenylobacterium,* and *Novosphingobium.* In some embodiments, the abundance of endophytes comprising a nucleic acid sequence that is at least 97% identical to a nucleic acid sequence selected from the group consisting of SEQ ID NOs. 5-15, 198, 200, and 204 is increased in in the microbial communities of treated plants relative to the microbial communities of reference plants. In a preferred embodiment, this method of enriching a treatment library is applied to treatments for soybeans or other plants capable forming an association with a nitrogen fixing microorganism, including plants capable of natural associations such as legumes, or plants or microbes modified to form such an association.

In some embodiments of methods of the present invention, a treatment library is enriched by selecting one or more treatments where Dothideomycetes are enriched relative to Sordariomycetes in the microbial communities of treated plants compared to the microbial communities of reference plants. In some embodiments, the treatment library is enriched by selecting one or more treatments where the average abundance of Dothideomycetes relative to Sordariomycetes in the microbial communities of treated plants is increased compared to the average abundance of Dothideomycetes relative to Sordariomycetes in the microbial communities of reference plants. In some embodiments, the log fold change of Dothideomycetes abundance relative to Sordariomycetes abundance in the microbial communities of treated plants is at least 0.1, at least 0.5, at least 1, between 0.5 and 1.5, at least 1.5, between 1 and 2, at least 2. Log fold change is calculated by taking the log (for example, base 2 or base 10) of the ratio of the average abundance of Dothideomycetes to the average abundance of Sordariomycetes. In some embodiments, the abundance of endophytes of the following taxonomic categorizations are increased in the microbial communities of treated plants relative to the microbial communities of reference plants: Pleosporales, Botryosphaeriales, Pleosporaceae, Leptosphaeriaceae, Phaeosphaeriaceae, Botryosphaeriaceae, *Cochliobolus, Leptosphaeria, Ophiosphaerella, Macrophomina, Phoma, Alternaria, Neosetophoma, Epicoccum.* In some embodiments, the abundance of endophytes comprising a nucleic acid sequence that is at least 97% identical to a nucleic acid sequence selected from the group consisting of SEQ ID NOs. 310, 315-332, 335-364, 367-377, 392-433, 460-474, 575-636 is increased in in the microbial communities of treated plants relative to the microbial communities of reference plants. In some embodiments of methods of the present invention, a treatment library is enriched by selecting one or more treatments where Dothideomycetes are enriched relative to Sordariomycetes in the microbial communities of treated plants compared to the microbial communities of reference plants where the plants were subjected to one or more environmental or biotic stresses. In some embodiments, the environmental stress is nutrient deficiency of the growth media, cold stress, or flood conditions.

In some embodiments, the treatment library is enriched by selecting one or more treatments that increase the taxonomic diversity of the microbial communities of the treated plants compared to the microbial communities of the reference plants. In some embodiments, taxonomic diversity includes species richness. In some embodiments, taxonomic diversity includes evenness. In some embodiments, taxonomic diversity is the number of difference taxonomic classifications at each level of the taxonomic hierarchy. For example, a profiled microbial community of a treated plant which contains microbes from 5 different Phyla has increased taxonomic diversity relative to a profiled microbial community of a reference plant which contains microbes from 3 different Phyla. In some embodiments, the treatment library is enriched by selecting one or more treatments where the increase in taxonomic diversity of the microbial communities of the treated plants is an increase in the number of Phyla of at least 25%, between 25% and 50%, at least 30%, at least 40%, between 40%-60%, at least 50%, at least 60% relative to the microbial communities of the reference plants. In some embodiments, the treatment library is enriched by selecting one or more treatments where the increase in taxonomic diversity of the microbial communities of the treated plants is an increase in the number of Classes of at least 5%, at least 10%, between 10% to 25%, between 10% and 50%, at least 15%, at least 25%, between 25% and 50%, at least 30%, at least 40%, at least 40%-60%, at least 50%, at least 60% relative to the microbial communities of the reference plants. In some embodiments, the treatment library is enriched by selecting one or more treatments where the increase in taxonomic diversity of the microbial communities of the treated plants is an increase in the number of Orders of at least 2%, between 2% and 15%, at least 5%, at least 10%, between 10% to 25%, between 10% and 50%, at least 15%, at least 25%, between 25% and 50%, at least 30%, at least 40%, at least 40%-60%, at least 50%, at least 60% relative to the microbial communities of the reference plants. In some embodiments, the treatment library is enriched by selecting one or more treatments where the increase in taxonomic diversity of the microbial communities of the treated plants is an increase in the number of Families of at least 5%, at least 10%, between 10% to 25%, between 10% and 50%, at least 15%, at least 25%, between 25% and 50%, at least 30%, at least 40%, at least 40%-60%, at least 50%, at least 60% relative to the microbial communities of the reference plants. In some embodiments, the treatment library is enriched by selecting one or more treatments where the increase in taxonomic diversity of the microbial communities of the treated plants is an increase in the number of Genera of at least 2%, between 2% and 15%, at least 5%, at least 10%, between 10% to 25%, between 10% and 50%, at least 15%, at least 25%, between 25% and 50%, at least 30%, at least 40%, at least 40%-60%, at least 50%, at least 60% relative to the microbial communities of the reference plants. In some embodiments, the increase in taxonomic diversity in the microbial communities of the treated plants relative to the microbial communities of the reference plants comprises presence in the profiled community of additional taxonomic classifications including: Chthonomonadetes, TK10, Acidobacteria, Spartobacteria, Cyanobacteria, Acidobacteria_Gp6, Deltaproteobacteria, C0119, Chthonomonadales, Legionellales, Subgroup_4, Chthoniobacterales, SubsectionIII, Gp6, Myxococcales, Chthonomonadaceae, Legionellaceae, Alicyclobacillaceae, Paenibacillaceae, Chthoniobacteraceae, Nitrosomonadaceae, A0839, *Chthonomonas*/Armatimonadetes_gp3, *Legionella, Blastocatella, Planctomyces, Tumebacillus, Ammoniphilus, Chthoniobacter, Sediminibacterium,* and *Planktothrix.*

In some embodiments, the increase in taxonomic diversity in the microbial communities of the treated plants relative to the microbial communities of the reference plants comprises increased abundance in the profiled community of taxonomic classifications including: Armatimonadetes, Planctomycetes, Bacteroidetes, *Acidobacteria, Verrucomicrobia, Firmicutes, Deltaproteobacteria, Chthonomonadetes, Acidobacteria*_Gp6, TK10, *Ktedonobacteria, Bacilli Spartobacteria, Planctomycetacia, Sphingobacteriia, Opitutae, Myxococcales, Legionellales, Chthonomonadales*, Gp6, C0119, Bacillales, Chthoniobacterales, Micromonosporales, Planctomycetales, Sphingobacteriales, Streptomycetales, Opitutales, Nitrosomonadales, Sphingomonadales, Pseudomonadales, Legionellaceae, Paenibacillaceae 2, Chthonomonadaceae, Alicyclobacillaceae, Gp6, Bacilaceae, Nitrosomonadaceae, Paenibacillaceae, Chthoniobacteraceae, Micromonosporaceae, Planctomycetaceae, Methylobacteriaceae, Sphingobacteriaceae, Moraxellaceae, Streptomycetaceae, Hyphomicrobiaceae, Bradyrhizobiaceae, Opitutaceae, Comamonadaceae, Sphingomonadaceae, *Legionella, Ammoniphilus, Chthonomonas*/Armatimonadetes_gp3, *Planctomyces, Sediminibacterium, Tumebacillus, Pedobacter, Bacillus, Paenibacillus, Chthoniobacter, Catenuloplanes, Fibrella, Methylobacterium, Sphingomonas, Acinetobacter, Ralstonia, Duganella, Escherichia/Shigella, Variovorax, Pelomonas, Streptomyces, Sphingobacterium, Devosia, Herbaspirillum, Bradyrhizobium, Opitutus, Pantoea,* and *Pseudomonas*. In some embodiments, the increase in abundance is at least about 1%, between 1% and 2%, at least about 2%, between 2% and 3%, at least about 3%, between 3% and 5%, at least about 5%, between 5% and 10%, at least about 8%, at least about 10%, between 10% and 15%, at least about 15%, between 15% and 20%, at least about 20%, between 20% and 25%, at least about 25%, between 25% and 30%, at least about 30%, between 30% and 40%, at least about 40%, between 40% and 50%, at least about 50%, between 50% and 60%, at least about 60%, between 60% and 75%, at least about 75%, between 75% and 80%, at least about 80%, between 80% and 85%, at least about 85%, between 85% and 90%, at least about 90%, between 90% and 95%, at least about 95%, between 95% and 99%, at least about 99% or at least 100%, relative to the microbial communities of reference plants. In a preferred embodiment, abundance is relative abundance. Relative abundance is the number of reads assigned to the category, normalized by the total number of reads in the sample.

In some embodiments, a treatment library is enriched by selecting one or more treatments where there is reduced abundance in the profiled microbial communities of the treated plants relative to the microbial communities of the reference plants of the taxonomic classifications: Chloroflexia, Verrucomicrobiae, Verrucomicrobiales, Herpetosiphonales, Verrucomicrobiaceae, Herpetosiphonaceae, *Agrobacterium, Verrucomicrobium, Simplicispira,* and *Herpetosiphon*. In some embodiments, reduced abundance includes absence. In some embodiments, the abundance is reduced by at least about 1%, between 1% and 2%, at least about 2%, between 2% and 3%, at least about 3%, between 3% and 5%, at least about 5%, between 5% and 10%, at least about 8%, at least about 10%, between 10% and 15%, at least about 15%, between 15% and 20%, at least about 20%, between 20% and 25%, at least about 25%, between 25% and 30%, at least about 30%, between 30% and 40%, at least about 40%, between 40% and 50%, at least about 50%, between 50% and 60%, at least about 60%, between 60% and 75%, at least about 75%, between 75% and 80%, at least about 80%, between 80% and 85%, at least about 85%, between 85% and 90%, at least about 90%, between 90% and 95%, at least about 95%, between 95% and 99%, at least about 99% or at least 100%, relative to the microbial communities of reference plants.

In some embodiments, this method of enriching a treatment library is applied to treatments for monocots, including cereals, and especially for wheat, corn, oats and barley. In some embodiments, this method of enriching a treatment library is applied to treatment for dicots, including legumes. In some embodiments, the dicot is a cotton plant or soy plant.

In some embodiments, a plant library for plants capable of being improved by a treatment is provided herein. In some embodiments, the library of plants comprises plants of different species. For example, a plant library may comprise soy, wheat, corn, rice and other plants. In some embodiments, the library of plants comprises plants of the same species. For example, a plant library may comprise many different varieties of soybean such as Dairyland DSR1808R2Y, Pfister 38R25, Stine 3920, Stine 33E22, or other varieties. In some embodiments, the library of plants comprises plants comprising different modifications. In some embodiments, the library of plants includes plants selected from the group consisting of: plants of different genera, plants of different species, plants of different varieties of the same species, modified plants containing different modifications, modified plants containing the same modifications, or any combination thereof.

In some embodiments of any of the methods described herein, the efficacy of a treatment is determined by applying a treatment and an endophyte composition and selecting treatments based on the recovery or enrichment of the applied endophyte composition from the treated tissue to which the endophyte composition was also applied. In some embodiments, the endophytes applied and recovered are selected from Table 1. In some embodiments, the endophytes applied and recovered are selected from Table 3. In some embodiments, the endophytes applied and recovered are selected from Table 15. In some embodiments, the endophytes applied and recovered are of the Order Rhizobiales. In some embodiments, the endophytes applied and recovered are of the Family Bradyrhizobiaceae. In some embodiments, the endophytes applied and recovered are of the Genus *Bradyrhizobium*. In some embodiments, the endophytes applied and recovered comprise a nucleic acid sequence that is at least 97% identical to a nucleic acid sequence selected from the group consisting of SEQ ID NOs: 6, 7, 8, 9, 10, 50, 65, 253, 254, 273, 277, 511-529, and 546. In some embodiments, the endophytes applied and recovered comprise a nucleic acid sequence that is at least 97% identical to a nucleic acid sequence selected from the group consisting of SEQ ID NOs: 228-637.

In some embodiments of any of the methods of enriching a library, the method may be repeated so as to further enrich the library.

Synthetic Compositions for Improving Plant Health

In some embodiments, a treatment selected by any of the methods described herein may be developed into a synthetic composition. In some embodiments, a treatment may comprise a synthetic composition. A "synthetic composition" comprises one or more treatments combined by human endeavor with a heterologously disposed plant element or a treatment formulation, said combination which is not found in nature. In some embodiments, the term "synthetic composition" means one or more plant elements or formulation components combined by human endeavor with an endophyte composition. In some embodiments, the endophyte composition is isolated and purified. In some embodiments, said purified endophyte composition is mechanically or manually applied, artificially inoculated or disposed on a plant element in a manner that is not found on or in the plant element before application of the purified endophyte composition, e.g., said combination or association which is not found in nature. In some embodiments, "synthetic composition" is used to refer to a treatment formulation comprising an isolated, purified population of endophytes heterologously disposed to a plant element. In some embodiments, "synthetic composition" refers to a purified population of endophytes in a treatment formulation comprising additional compositions with which said endophytes are not found in nature.

In some embodiments, a treatment is heterologously disposed on a plant element in an amount effective to improve plant health. In some embodiments, treatments capable of improving plant health are applied in an amount effective to improve a trait of agronomic importance or tolerance by at least 0.1%, at least 0.5%, at least 1%, at least 2%, at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, at least 300% or more, as compared to a reference plant element not further comprising said endophyte.

As used herein, a "colony-forming unit" ("CFU") is used as a measure of viable microorganisms in a sample. A CFU is an individual viable cell capable of forming on a solid medium a visible colony whose individual cells are derived by cell division from one parental cell. In some embodiments, an "effective amount" of treatment comprising an endophyte is at least 10 CFU per seed, at least 10^2 CFU per seed, between 10^2 and 10^3 CFU per seed, at least about 103 CFU per seed, between 10^3 and 10^4 CFU per seed, at least about 10^4 CFU per seed, between 10^4 and 10^5 CFU per seed, at least about 10^5 CFU, between 10^5 and 10^6 CFU per seed, at least about 10^6 CFU per seed, between 10^6 and 10^7 CFU per seed, at least about 10^7 CFU per seed, between 10^7 and 10^8 CFU per seed, or even greater than 10^8 CFU per seed.

In some embodiments, the synthetic composition of the present invention is produced by a method of producing a treatment based on the enrichment of a treatment library, wherein the treatment is capable of improving plant health. In some embodiments, a synthetic composition comprises a plant element. In some embodiments, the synthetic composition of the present invention is produced by a method of producing a plant based on the enrichment of a plant library, wherein the selected plant is capable of being improved by a treatment.

In some embodiments, the synthetic composition of the present invention comprises one or more of the following: fungicide, nematicide, bactericide, insecticide, or herbicide.

Nucleic Acid Probes and Detection Kits

The present invention includes nucleic acid probes that are markers of plant health. These probes include single and double stranded nucleic acids, engineered polymers such as peptide nucleic acids, or combinations thereof. In some embodiments, there are a plurality of nucleic acid probes. In some embodiments, the nucleic acid probes are attached to one or more solid supports. In some embodiments, the nucleic acid probes are reversibly attached to one or more solid supports. In some embodiments, the nucleic acid probes are attached to a plurality of beads. In some embodiments, only one unique sequence is attached to each bead. In some embodiments, the nucleic acid probes are attached to a contiguous solid support. In some embodiments, the nucleic acid probes attached to a solid support are physically separated from non-identical probes by an indentation or raised portion the solid support.

In some embodiments, the nucleic acid probes of the present invention may comprise sequences complementary or reverse complementary to the entire length of any of SEQ ID NOs. 5-15, 49-113, 198, 200, 203, 204, or 228-637. In some embodiments, the nucleic acid probes of the present invention may comprise nucleic acid sequences complementary or reverse complementary to a nucleic acid sequence that is at least 97% identical to a nucleic acid sequence selected from the group consisting of SEQ ID NOs. 5-15, 49-113, 198, 200, 203, 204, and 228-637. In some embodiments, the nucleic acid probes of the present invention may comprise nucleic acid sequences complementary or reverse complementary to a nucleic acid sequence that is at least 97% identical to one or more nucleic acid sequences selected from SEQ ID NOs: 6, 7, 8, 9, 10, 50, 65, and combinations thereof. In some embodiments, the nucleic acid probes of the present invention may comprise sequences complementary or reverse complementary to a region within any of SEQ ID NOs. 5-15, 49-113, 198, 200, 203, 204, or 228-637. In some embodiments, the nucleic acid probes of the present invention may comprise sequences complementary or reverse complementary to a region within any of SEQ ID NOs: 6, 7, 8, 9, 10, 50, 65, 253, 254, 273, 277, 511-529, and 546. In some embodiments, the region within any of SEQ ID NOs to which the nucleic acid probe is complementary or reverse complementary is a contiguous region. In some embodiments, the region within any of SEQ ID NOs to which the nucleic acid probe is complementary or reverse complementary is at least 5 nucleotides (nt) in length, at least 10 nt in length, at least 15 nt, between 10 nt and 30 nt, between 10 and 20 nt, between 15 and 50 nt, at least 20 nt, between 20 and 60 nt, at least 25 nt, at least 30 nt, at least 40 nt, at least 50 nt, between 50 nt and 100 nt, at least 60 nt, at least 70 nt, at least 80 nt, at least 100 nt. In some embodiments, the nucleic acids probes are complementary or reverse complementary to a nucleic acid sequence selected from SEQ ID NOs. 5-15, 49-113, 198, 200, 203, 204, or 228-637. In some embodiments, the region within any of SEQ ID NOs to which the nucleic acid probe is complementary or reverse complementary is not a contiguous region.

In some embodiments, a nucleic acid probe is capable of hybridizing to one or more nucleic acid sequences selected from SEQ ID NOs. 5-15, 49-113, 198, 200, 203, 204, or 228-637, or reverse complementary sequences thereof. In some embodiments, the nucleic acid probe is capable of hybridizing under moderate conditions. "Moderate conditions" are 0.165M-0.330M NaCl and 20-29 degrees Celsius below the melting temperature of the nucleic acid probe. In some embodiments, the nucleic acid probe is capable of hybridizing under stringent conditions. "Stringent conditions" are 0.0165M-0.0330M NaCl and 5-10 degrees Celsius below the melting temperature of the nucleic acid probe.

In some embodiments, the nucleic acid probes are a component of a nucleic acid detection kit. In some embodiments, the nucleic acid probes are a component of a DNA detection kit. In some embodiments, the nucleic acid detection kit comprises additional reagents. In some embodiments, the contents of the nucleic acid detection kit are utilized in performing DNA sequencing.

Method of Marketing a Plant Treatment

The methods of the present invention include methods of marketing plant treatments. In some embodiments, plant treatments are marketed to farmers. The methods of the present invention provide on farm validation of the efficacy of treatment to a farmer. In some embodiments, plants selected from treated and reference populations can be prepared for profiling on the farmer's land or send to a laboratory facility for processing. In some embodiments, the microbial communities of selected plants are profiled on the farmer's land or send to a laboratory facility for processing. In some embodiments, the plant tissues are collected using automated farm equipment. In some embodiments, samples are profiled by DNA sequencing on a farmer's land. In some embodiments, the results of on-farm profiling are communicated electronically via the internet.

In some embodiments, the results of profiling the microbial community of selected plants are used to generate a recommendation of an agronomic activity. In some embodiments, the agronomic recommendation is communicated electronically via the internet. In some embodiments, the payment is communicated electronically via the internet. In some embodiments, the recommendation is based on the taxonomic diversity of the microbial communities of treated plants compared to the microbial communities of reference plants. In some embodiments, the recommendation is based on the relative abundance of Alphaproteobacteria relative to Gammaproteobacteria in the microbial communities of treated plants compared to the microbial communities of reference plants. In some embodiments, the recommendation is based on the relative abundance of Dothideomycetes relative to Sordariomycetes in the microbial communities of treated plants compared to the microbial communities of reference plants. In some embodiments, the recommendation is based on the relative abundance of one or more endophytes comprising a nucleic acid sequence that is at least 97% identical to a nucleic acid sequence selected from the group consisting of SEQ ID NOs. 5-15, 49-113, 198, 200, 203, 204, 228-637.

In some embodiments, the results of profiling the microbial community of selected plants are used to charging a customer an amount for a product or service. In some embodiments, the results of profiling the microbial community of selected plants are used to pay a customer an amount for a crop. In some embodiments, the payment is a charge to a customer by a provider of agronomic products or services that used to produce a crop. In some embodiments, the customer is a farmer. In some embodiments, the payment is compensation to the producer of an agricultural crop. In some embodiments, the payment communicated electronically via the internet. In some embodiments, the payment is based on the taxonomic diversity of the microbial communities of treated plants compared to the microbial communities of reference plants. In some embodiments, the payment is based on the relative abundance of Alphaproteobacteria relative to Gammaproteobacteria in the microbial communities of treated plants compared to the microbial communities of reference plants. In some embodiments, the payment is based on the relative abundance of Dothideomycetes relative to Sordariomycetes in the microbial communities of treated plants compared to the microbial communities of reference plants. In some embodiments, the payment is based on the relative abundance of one or more endophytes comprising a nucleic acid sequence that is at least 97% identical to a nucleic acid sequence selected from the group consisting of SEQ ID NOs. 5-15, 49-113, 198, 200, 203, 204, 228-637.

In some embodiments, the reference plants are grown concurrently with treated plants on a farmer's farm. In some embodiments, the reference plants were previously grown on the farmer's farm. In some embodiments, the reference plants were previously grown at a different farm. In some embodiments, the reference plants are grown on other farms in the same geographic area. In some embodiments, the geographic region is a county. In some embodiments, the geographic region is a state. In some embodiments, the reference plants are grown on other farms having similar soil, climate or other environmental conditions.

The invention will be further described in the following examples, which do not limit the scope of the invention described in the claims. Each patent application, journal article, citation, and other references are herein incorporated by reference in their entirety, as if each has been incorporated by reference individually.

EXAMPLES

Example 1. Collection of Samples

Sample Collection

Figure 2:
FIG. 2 represents exemplary soy plants, showing three soy plants that are larger and more robust (left) compared to the three soy plants that are smaller, less green and less vibrant.
Figure 3:
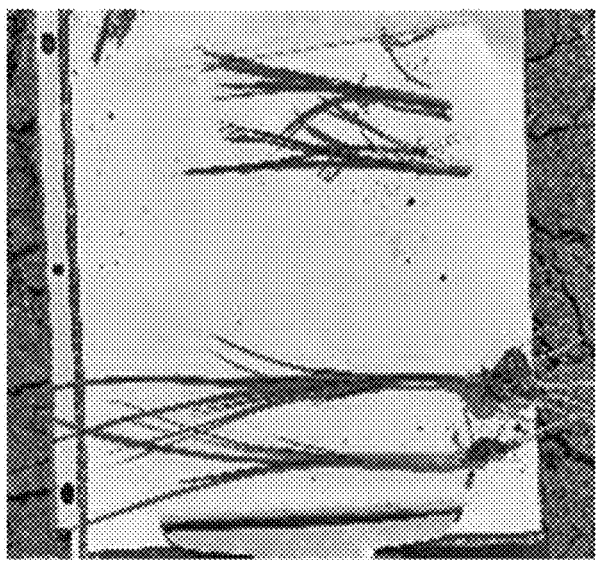
FIG. 3 represents exemplary soy, corn, and rice plants. The left-most panel shows three soy plants that are smaller, less green and less vibrant (left) compared to three soy plants that are larger and more robust (right). The middle panel shows a corn plant that is smaller, less green and less vibrant (left) compared to a corn plant that is larger and more robust (right). The right-most panel shows two rice plants that are smaller, less green and less vibrant (right) compared to rice plants that are larger and more robust (left).
Figure 3:
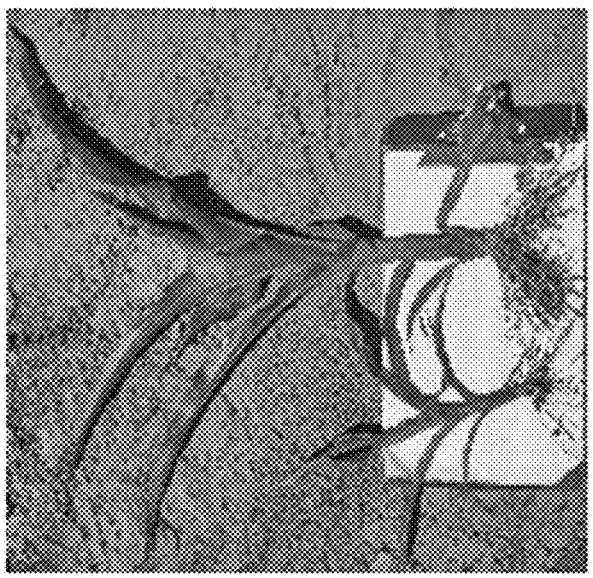
Figure 3:
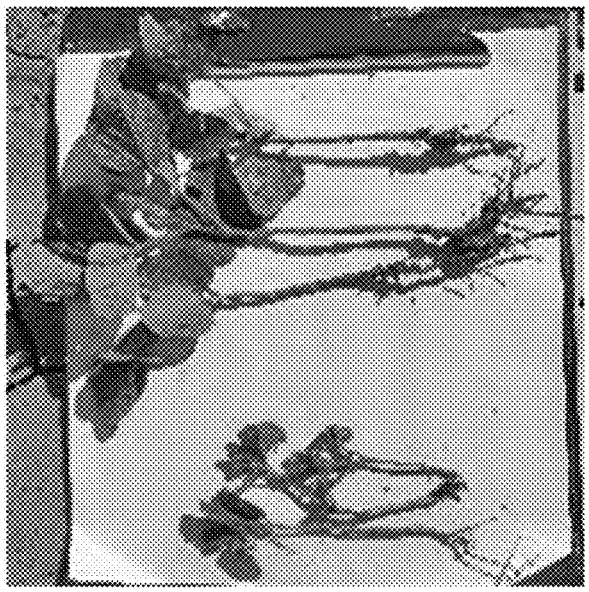

Leaf and root tissue were collected from corn, soybean and rice plants that were grown under commercially relevant field conditions. Within each crop, development stage, and sampling location, equivalent numbers of samples were collected from healthy plants which were larger and more robust plants and from unhealthy plants which were smaller, less green and less vibrant. Exemplary photos of healthy and unhealthy plants are shown in FIGS. 1-3. At least 25 samples for each phenotype/crop combination were collected at each site sampled.

DNA Extraction

Each sample was processed independently. Each sample was washed in a dilute water and detergent solution; 2 g of rinsed root and shoot tissue was collected from corn, 1 g of tissue was collected from rice and soy plants. Samples were surface sterilized by successive rinses: 2 minutes in 10% bleach solution, 2 minutes in 70% ethanol solution, and a rinse with sterile water. The series of rinses was repeated 3 times. The plant tissue was cut into small pieces with sterile scissors and blended with 3, 7 mm steel beads in 5-7.5 ml phosphate buffered solution (PBS). DNA was extracted from the ground tissues using the Magbind Plant DNA kit (Omega, Norcross, Georgia, USA) according to the manufacturer's instructions.

Example 2. High-Throughput Community Sequencing and OTU Assignment

Marker genes were amplified and sequenced from the extracted DNA. For the bacterial and archaeal analyses, the V4 hypervariable region of the 16S rRNA gene was amplified using primer 515f: 5'-GTGCCAGCMGCCGCGGTAA-3' (SEQ ID NO: 3) and primer 806r: 5'-GGAC-TACHVGGGTWTCTAAT-3' (SEQ ID NO: 4); where M is A or C; H is A or T or C; V is A or C or G; and W is A or T. For the fungal community analysis, the second internal transcribed spacer (ITS2) region of the rRNA operon was amplified using primer fITS7: 5'-GTGART-CATCGAATCTTTG-3' (SEQ ID NO: 210) and primer ITS4: 5'-TCCTCCGCTTATTGATATGC-3' (SEQ ID NO: 211) where R is A or G. The two marker genes were PCR amplified separately using 35 cycles, and staggered 9-bp barcoded primers specific to each sample were used to facilitate combining of samples. To reduce the amplification of chloroplast and mitochondrial DNA, PNA clamps specific to the rRNA genes in these organelles were used. PCR reactions to amplify 16S rRNA and ITS regions followed the protocol of Kozich et al. (2013) (Kozich, Westcott, Baxter, Highlander, & Schloss, 2013). PCR products were cleaned with Agencourt AMPure XP beads at a 0.7:1 bead-to-library ratio (Beckman Coulter), quantified using the PicoGreen assay (Life Technologies, Inc., Grand Island, NY) and pooled in equimolar concentrations. The final library was quantified by qPCR using the KAPA Library quantification kit (KAPA Biosystems) and diluted to 4 nM. In preparation for cluster generation and sequencing, pooled libraries were denatured with NaOH, diluted with hybridization buffer, and then heat denatured before MiSeq sequencing (Illumina). Each run included a minimum of 2.5% PhiX to serve as an internal control.

OTU Assignment

For 16S rRNA and ITS2 sequences, the raw sequence data were reassigned to distinct samples based on barcode sequences introduced during library prep, and quality filtering and OTU (i.e. operational taxonomic unit) clustering was conducted using the UPARSE and USEARCH pipelines (Edgar 2013). Each endophyte was assigned to an Operational Taxonomic Unit (OTU). OTU clustering (Rideout et al, 2014) was performed using a cascading approach, comparing the sequences against the Greengenes (McDonald et al., 2012) and SILVA (Quast et al., 2013) and UNITE (Abarenkov et al., 2010) reference databases, which are provided with full-length clustering at various widths. Bacterial sequences were compared to the combined Greengenes 99% OTU representative sequences and SILVA non-redundant sequences. Sequences without a 99% match to the combined reference 99% OTUs but having a 97% match were assigned to 97% OTUs with the best match representative sequence from the 99% reference sequences. Fungal sequences were compared to the UNITE Dynamic OTU representative sequences, where dynamic represents values between 97% and 99% depending on the OTU. Sequences that did not match the UNITE Dynamic OTUs at the appropriate clustering level, but did have a 97% match were assigned to 97% OTUs with best match representative sequence from the Dynamic OTUs. The remaining sequences that did not match any of the three reference databases, Greengenes. SILVA, or UNITE, but were present at a level of at least 10 reads across the samples, were de novo clustered using UPARSE (independently for the bacterial and fungal sequences). Sequences that did not match a reference sequence were mapped to the de novo OTUs at 97%. Remaining sequences that did not match either a reference or de novo OTU were removed from this analysis. Only samples having at least 1000 reads after quality filtering were retained, and only OTUs with a mean relative abundance of at least 0.001% within at least one sample were included in this analysis. The relative abundance of OTUs in all samples were summarized in an OTU table.

Example 3. Diversity Analysis to Detect Plant Health in Cereal Crops

The OTU tables generated in Example 2 were used to measure the number of taxonomic units detected (observed diversity) and alpha diversity in the microbial communities for corn (*Zea mays*).

Figure 7A:
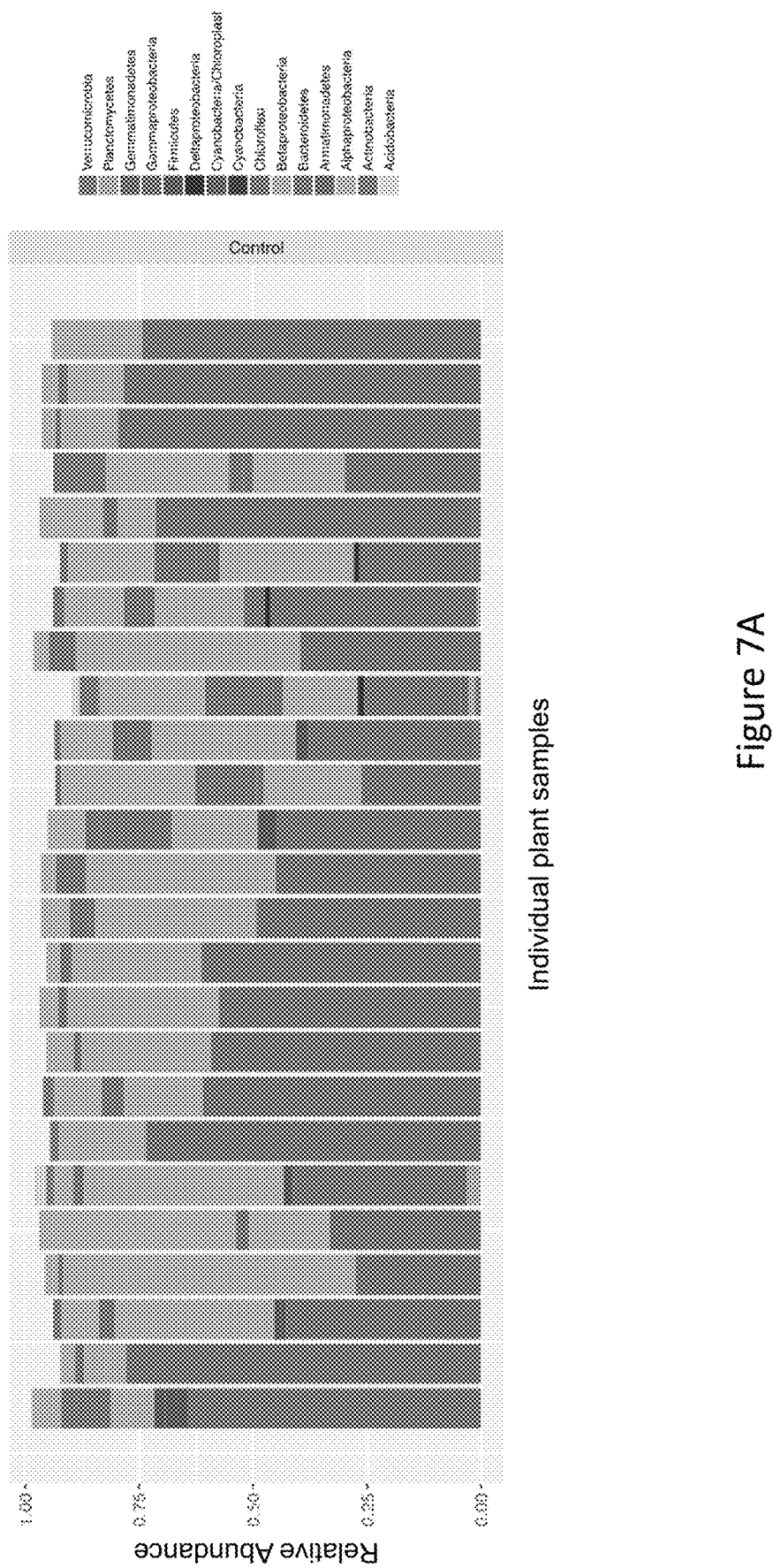
FIG. 7A shows the relative abundance of Phyla and Proteobacteria Classes in corn plants at stage V4 that are less robust corn plants (labeled Control).
Figure 7B:
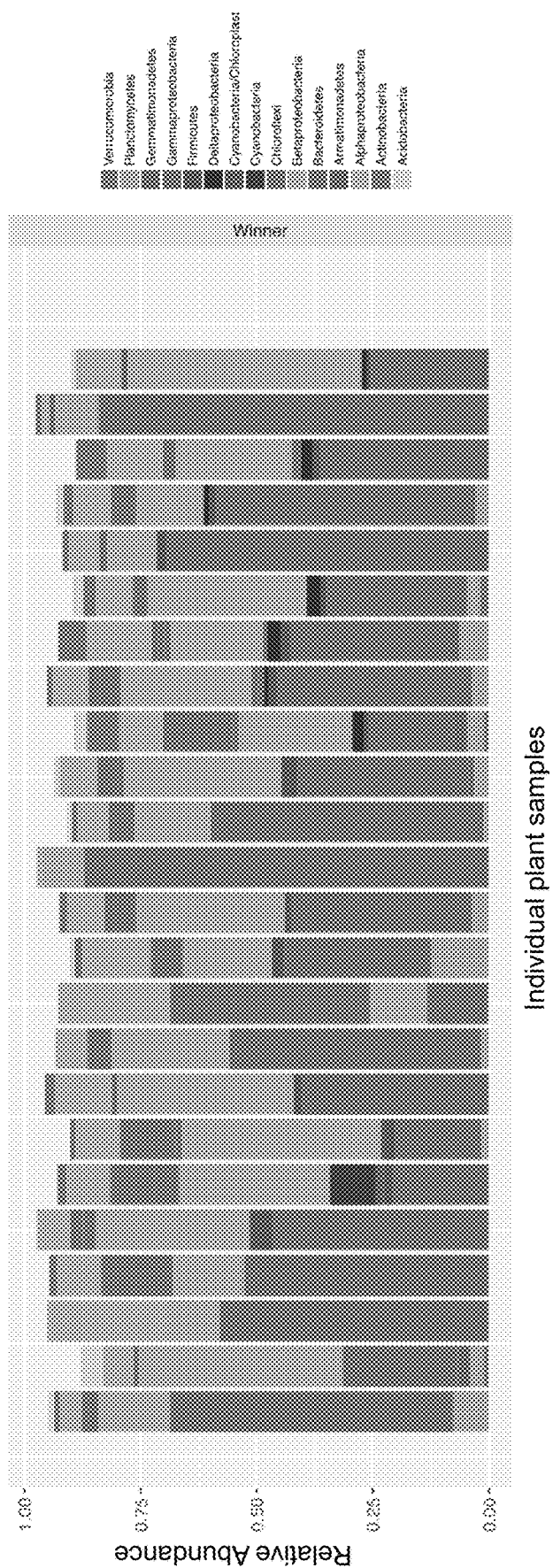
FIG. 7B shows the relative abundance of Phyla and Proteobacteria Classes in samples that are more robust (labeled Winner). Individual samples are displayed along the x-axis, the relative abundance of OTU in the taxonomic categories listing in the legend are shown on the y-axis. It is apparent that there are more diverse taxonomic categorizations represented in the microbial communities of the more robust corn plants compared to the microbial communities of less robust plants. The communities were profiled by 16S sequencing as described in Example 2.

FIGS. 7A and 7B show the relative abundance of Phyla and Proteobacteria Classes in corn plants at stage V4. FIG. 7A shows samples that are less robust corn plants (labeled Control). FIG. 7B shows samples that are more robust (labeled Winner). Individual samples are displayed along the x-axis, the relative abundance of OTU in the taxonomic categories listing in the legend are shown on the y-axis. It is apparent that there are more diverse taxonomic categorizations represented in the microbial communities of the more robust corn plants compared to the microbial communities of less robust plants.

Figure 4A:
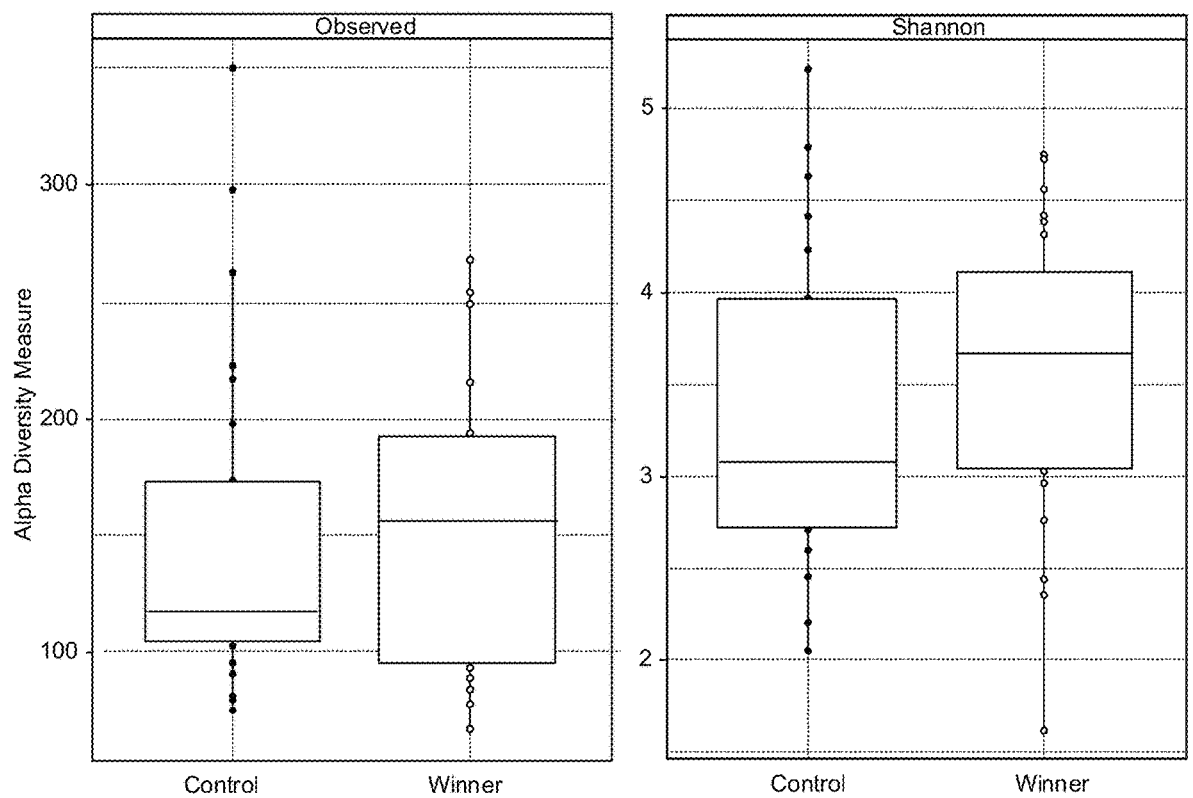
FIG. 4A shows the increase in observed and alpha diversity of bacterial communities in V4 stage corn plants. In both the left and right panels, the box plot on the left shows the diversity of OTU of samples from less robust plants (labeled Control), and the box plot on the right the diversity of OTU of samples from robust plants (labeled Winner). The communities were profiled by 16S sequencing as described in Example 2.
Figure 4B:
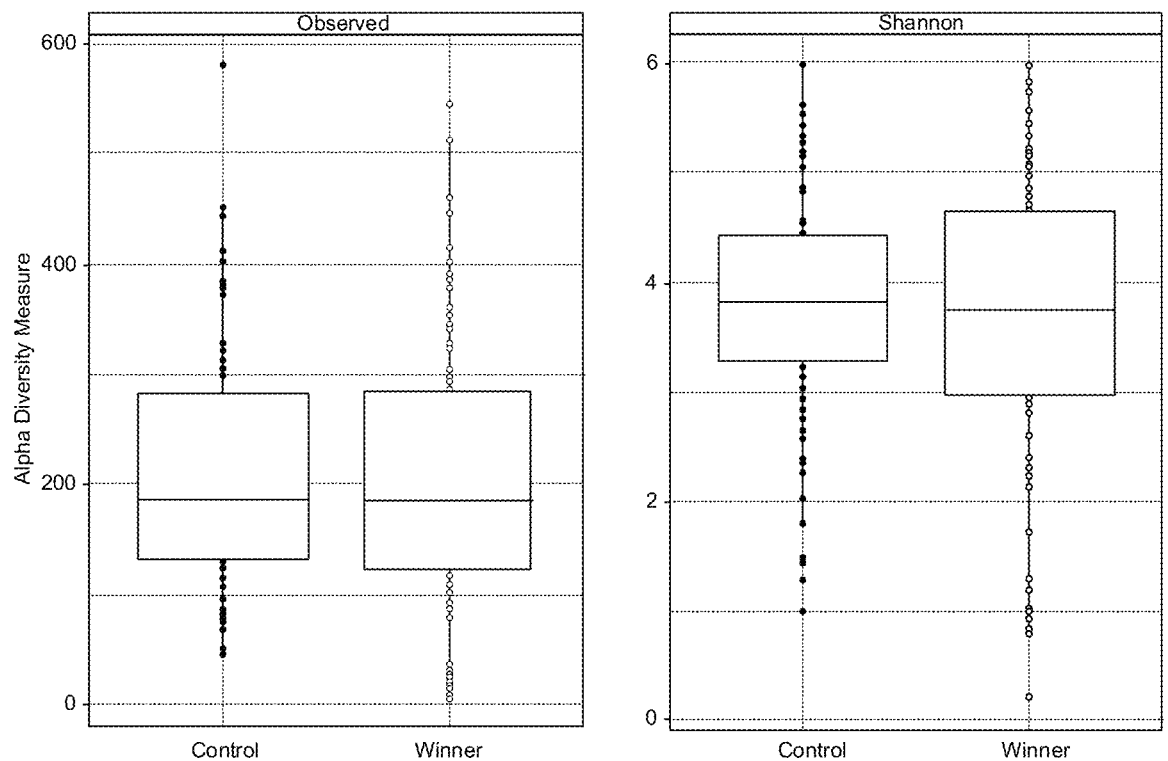
FIG. 4B shows the observed and alpha diversity of bacterial communities in V5 stage rice plants. In both the left and right panels, the box plot on the left shows the diversity of OTU of samples from less robust plants (labeled Control), and the box plot on the right the diversity of OTU of samples from robust plants (labeled Winner). The communities were profiled by 16S sequencing as described in Example 2.
Figure 5A:
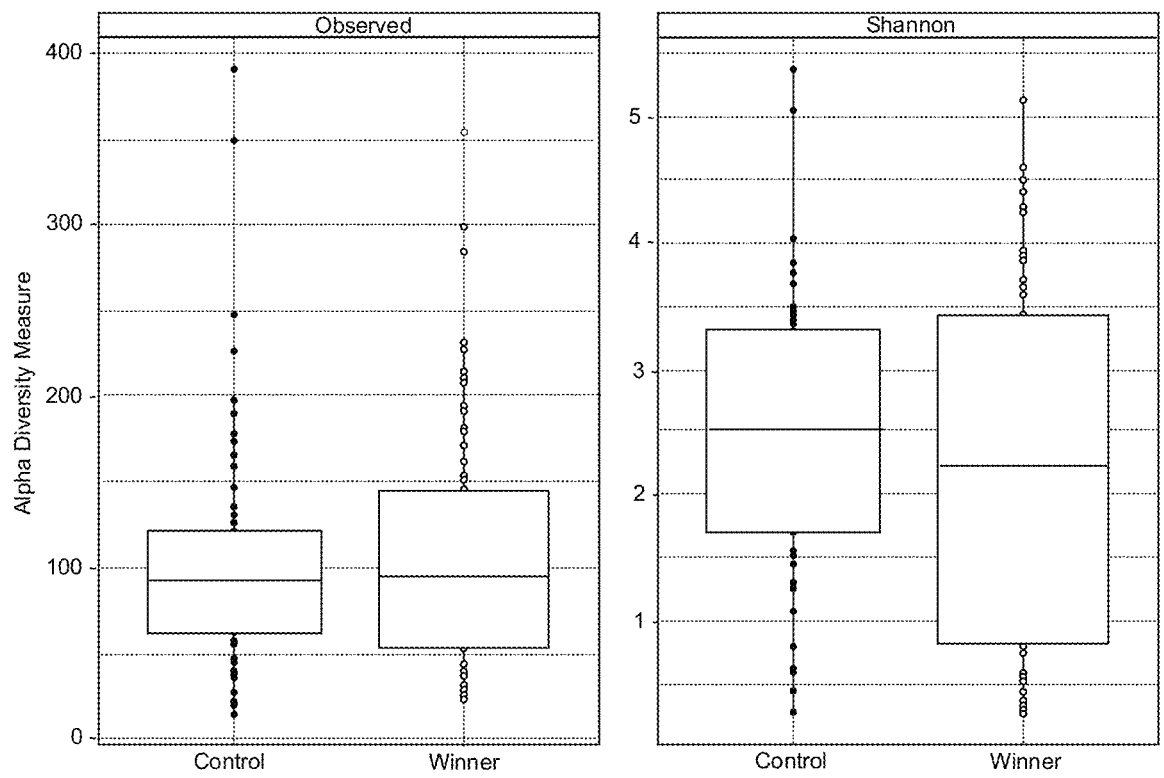
FIG. 5A shows the decrease in observed and alpha diversity of V1 stage soy plants.
Figure 5B:
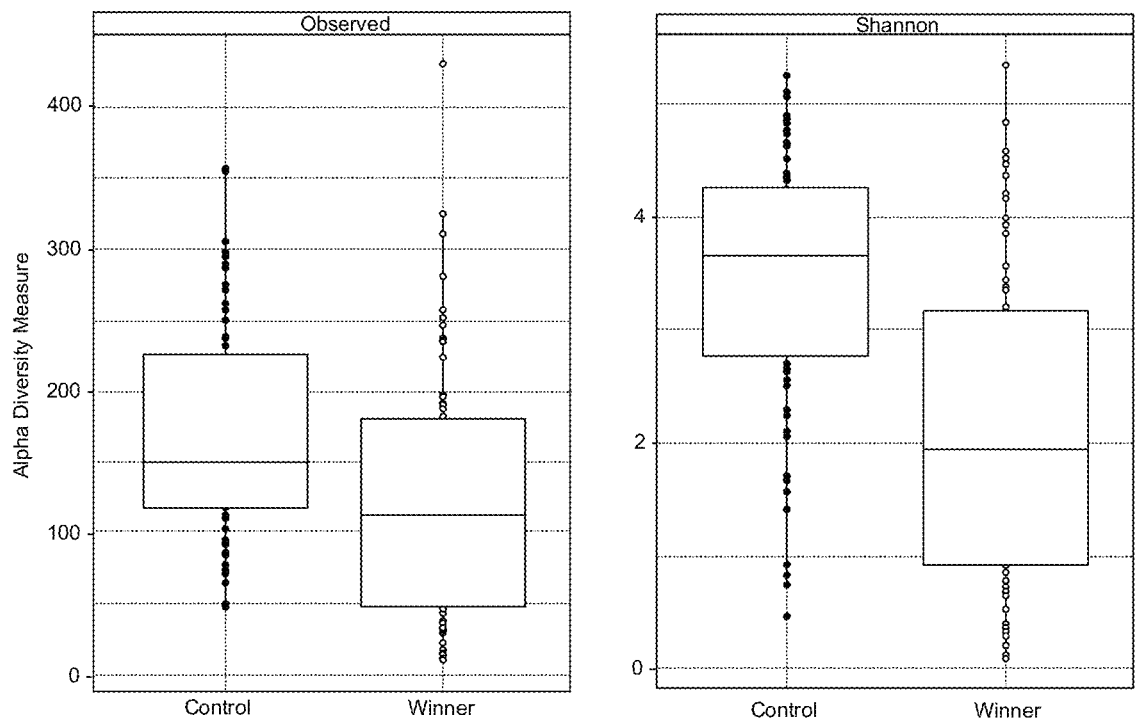
FIG. 5B shows the decrease in observed and alpha diversity of V2 stage soy plants. In both FIG. 5A and FIG. 5B the box plot on the left shows the diversity of OTU of samples from less robust plants (labeled Control), and the box plot on the right shows the diversity of OTU of samples from robust plants (labeled Winner). The communities were profiled by 16S sequencing as described in Example 2.

Both the observed and alpha diversity calculations show that increased observed and alpha diversity together are an indicator of plant health. For stage V4 corn (FIG. 4A), we see that alpha-diversity increases in the healthier plants, as measured both by observed and Shannon diversity. For stages V1 and V2 soy (FIG. 5), alpha-diversity is seen be unchanged or to decrease in healthier plants, as measured by observed and Shannon diversity.

Example 4. Relative Bacterial Taxonomic Ratio Analysis to Detect Plant Health

Methods

The relative taxonomic ratio for any sample can be calculated by the ratio between the proportion of reads in the OTU table assigned to one taxonomic group and the proportion of reads assigned to another taxonomic group. In this method, relative taxonomic ratio analysis was applied to the bacterial class Alphaproteobacteria and the bacterial class Gammaproteobacteria, and then log-transformed.

Results

Figure 6A:
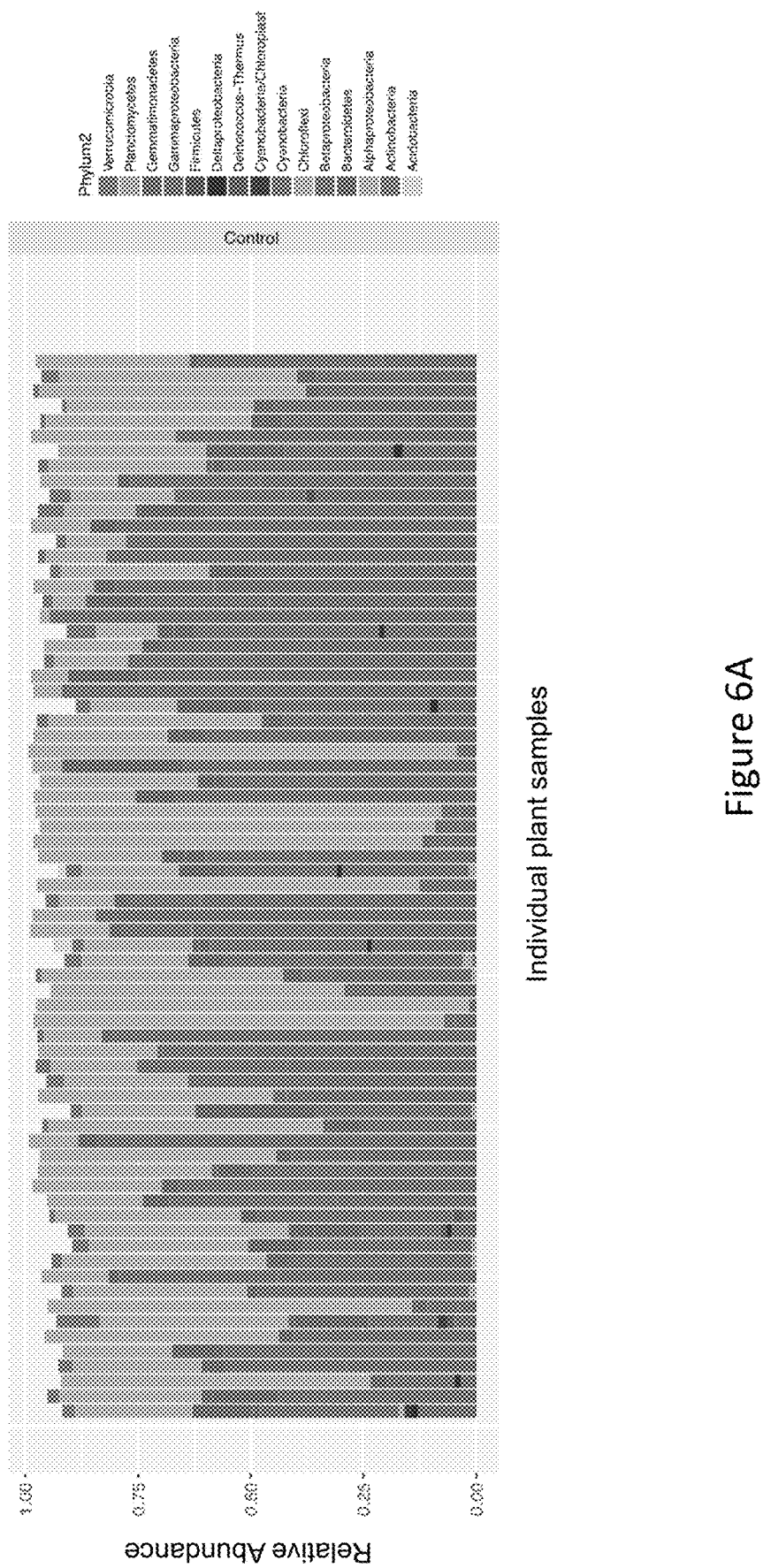
FIG. 6A shows the relative abundance of Phyla and Proteobacteria Classes in soybean plants at stage V2 that are less robust soy plants (labeled Control).
Figure 6B:
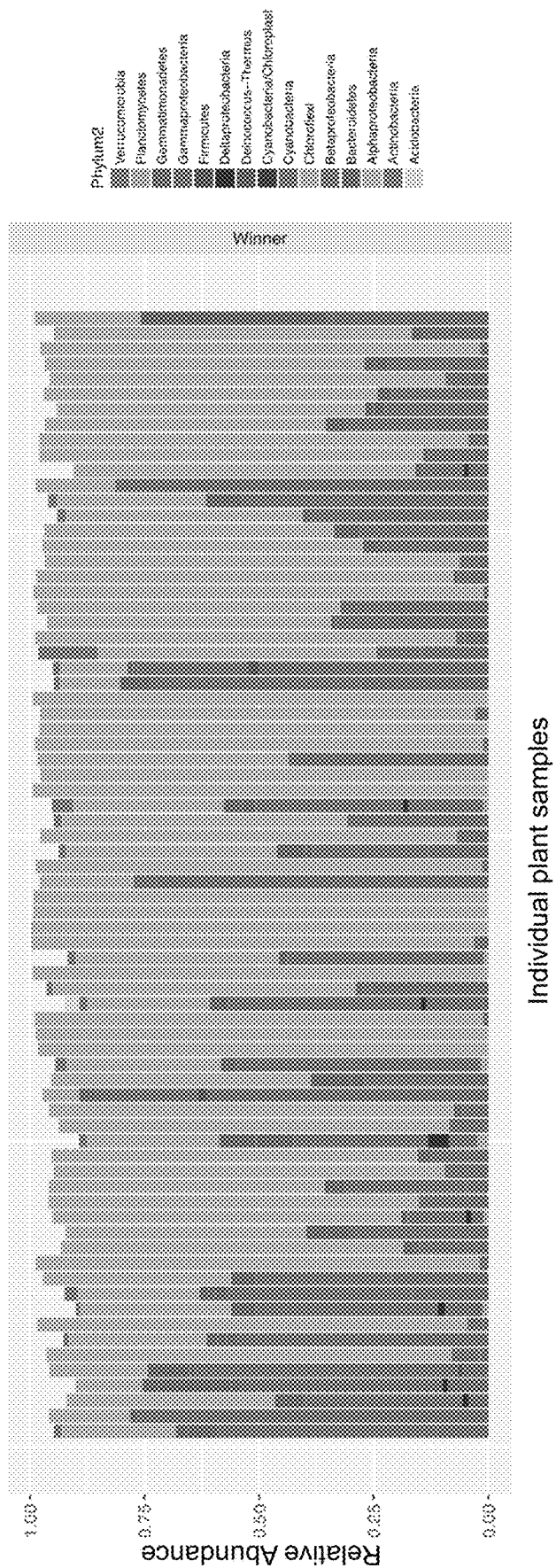
FIG. 6B shows the relative abundance of Phyla and Proteobacteria Classes in soybean plants at stage V2 that are more robust (labeled Winner). Individual samples are displayed along the x-axis, the relative abundance of OTU in the taxonomic categories listing in the legend are shown on the y-axis. It is apparent that Alphaproteobacteria are enriched relative to Gammaproteobacteria in the microbial communities of the more robust soybean plants compared to the microbial communities of less robust plants. The communities were profiled by 16S sequencing as described in Example 2.

The relative taxonomic ratio of Alphaproteobacteria:Gammaproteobacteria was calculated for stage V1 and V2 soy (*Glycine max*) crops. FIG. 6 shows the relative abundance of Phyla and Proteobacteria Classes in soybean plants at stage V2. FIG. 6A, shows samples that are less robust soy plants (labeled Control). FIG. 6B, shows samples that are more robust (labeled Winner). Individual samples are displayed along the x-axis, the relative abundance of OTU in the taxonomic categories listing in the legend are shown on the y-axis. It is apparent that Alphaproteobacteria are enriched relative to Gammaproteobacteria in the microbial communities of the more robust soybean plants compared to the microbial communities of less robust plants.

Figure 8A:
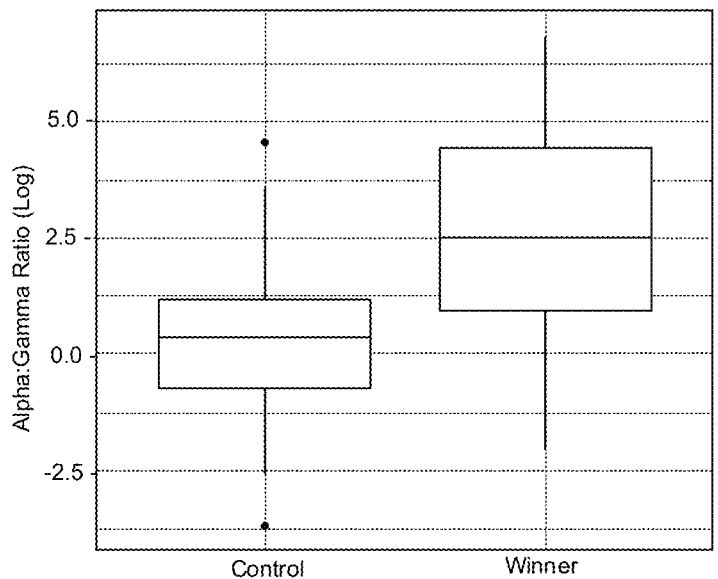
FIGS. 8A and 8B show the log ratio of the average abundance of Alphaproteobacteria divided by the average abundance of Gammaproteobacteria in the microbial communities profiled in less robust soybean plants (left box plot in each panel) and more robust soybean plants (right box plot in each panel).
Figure 8B:
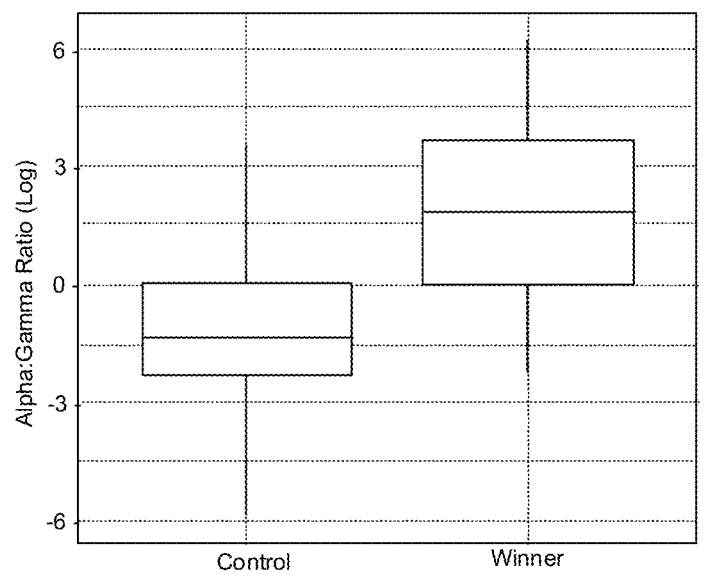
Figure 9:
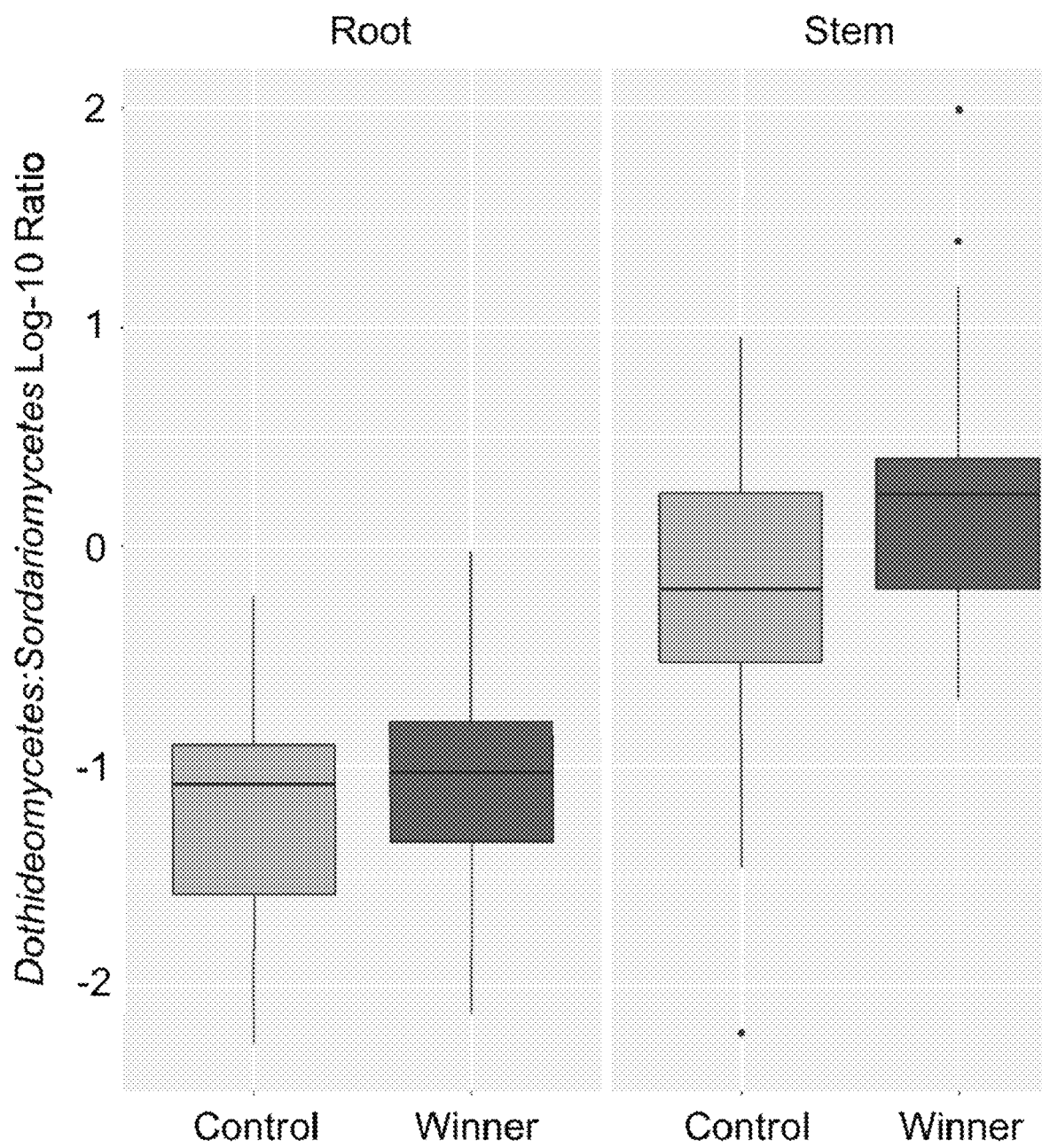
FIG. 9 shows the log ratio of the average abundance of Dothideomycetes divided by the average abundance of Sordariomycetes in the microbial communities profiled soybean plants at development stage v5 under cold stress; the left panel shows the relative community abundance in root tissue of less robust soybean plants (labeled Control, left box plot) and more robust soybean plants (labeled Winner, right box plot) and the right panel shows the relative community abundance in stem tissue of less robust soybean plants (labeled Control, left box plot) and more robust soybean plants (labeled Winner, right box plot). The communities were profiled by ITS sequencing as described in Example 2.
Figure 10:
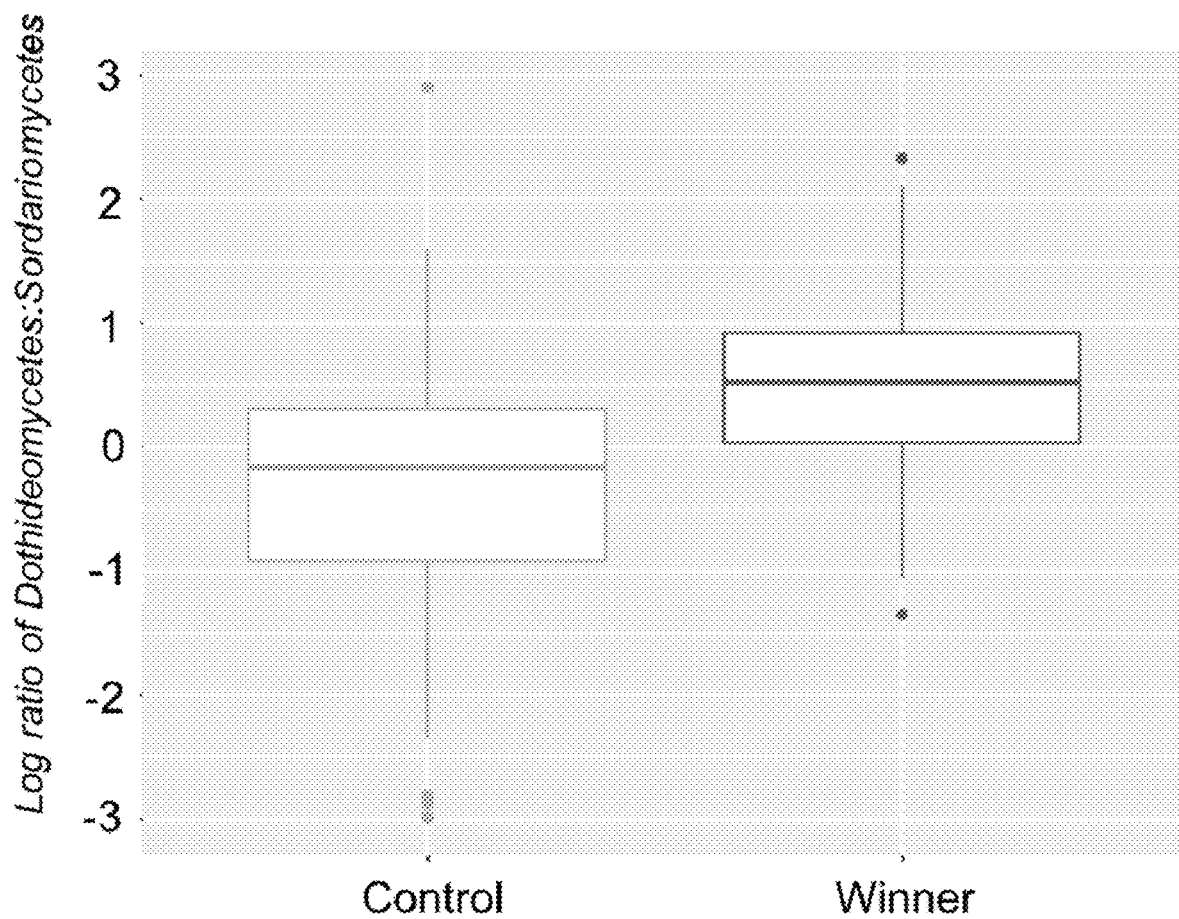
FIG. 10 shows the log ratio of the average abundance of Dothideomycetes divided by the average abundance of Sordariomycetes in the microbial communities of whole soybean plants at development stage v2 under nutrient deficient conditions; the left box plot shows the ratio in less robust soybean plants (labeled Control) and the right box plot shows the ratio in more robust soybean plants (labeled Winner). The communities were profiled by ITS sequencing as described in Example 2.
Figure 11:
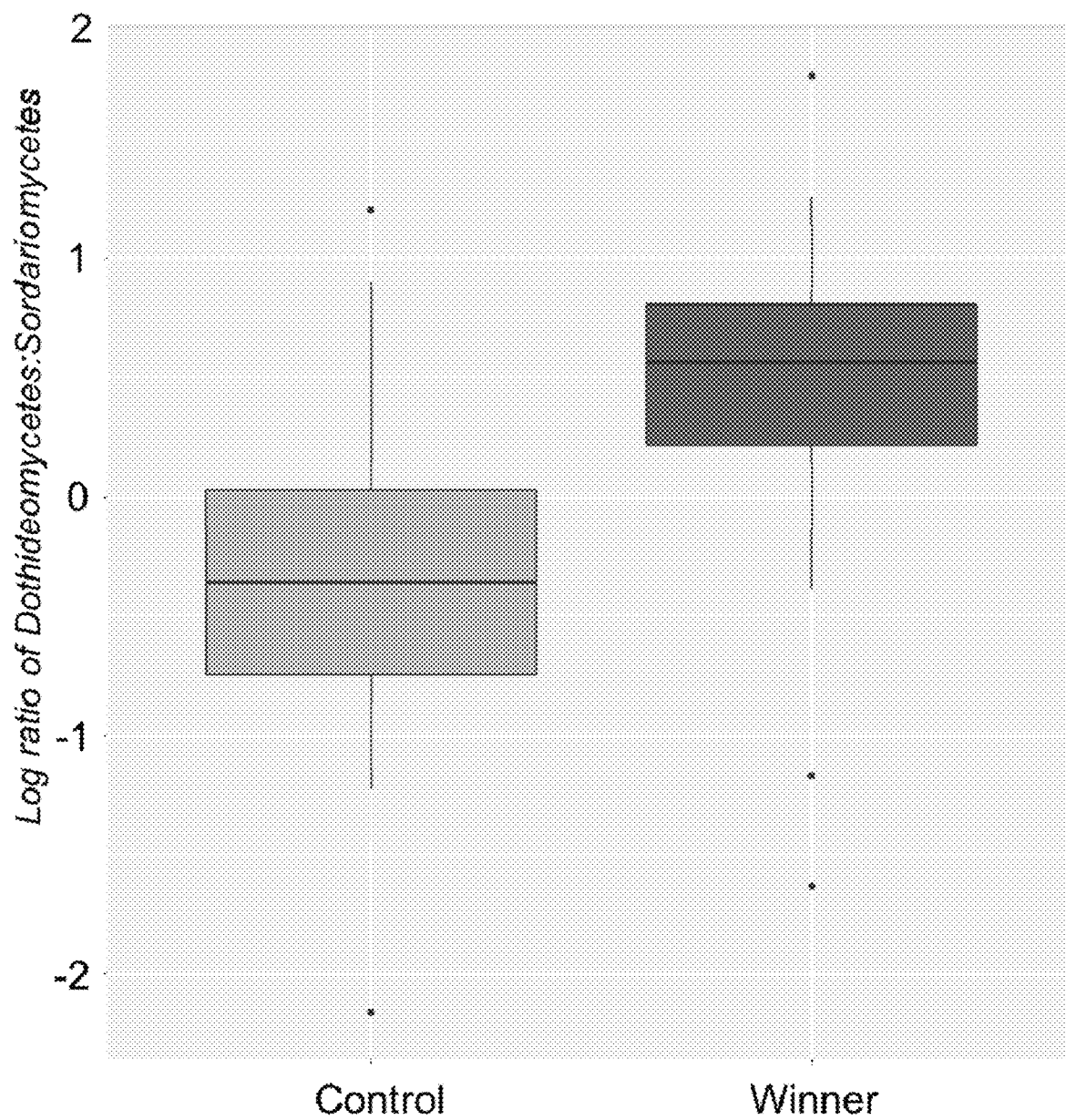
FIG. 11 shows the log ratio of the average abundance of Dothideomycetes divided by the average abundance of Sordariomycetes in the microbial communities profiled of root tissue of corn plants at development stage v7 under cold stress; the left boxplot shows the relative community abundance in less robust corn plants (labeled Control) and the right boxplot shows the relative community abundance in more robust corn plants (labeled Winner). The communities were profiled by ITS sequencing as described in Example 2.
Figure 12:
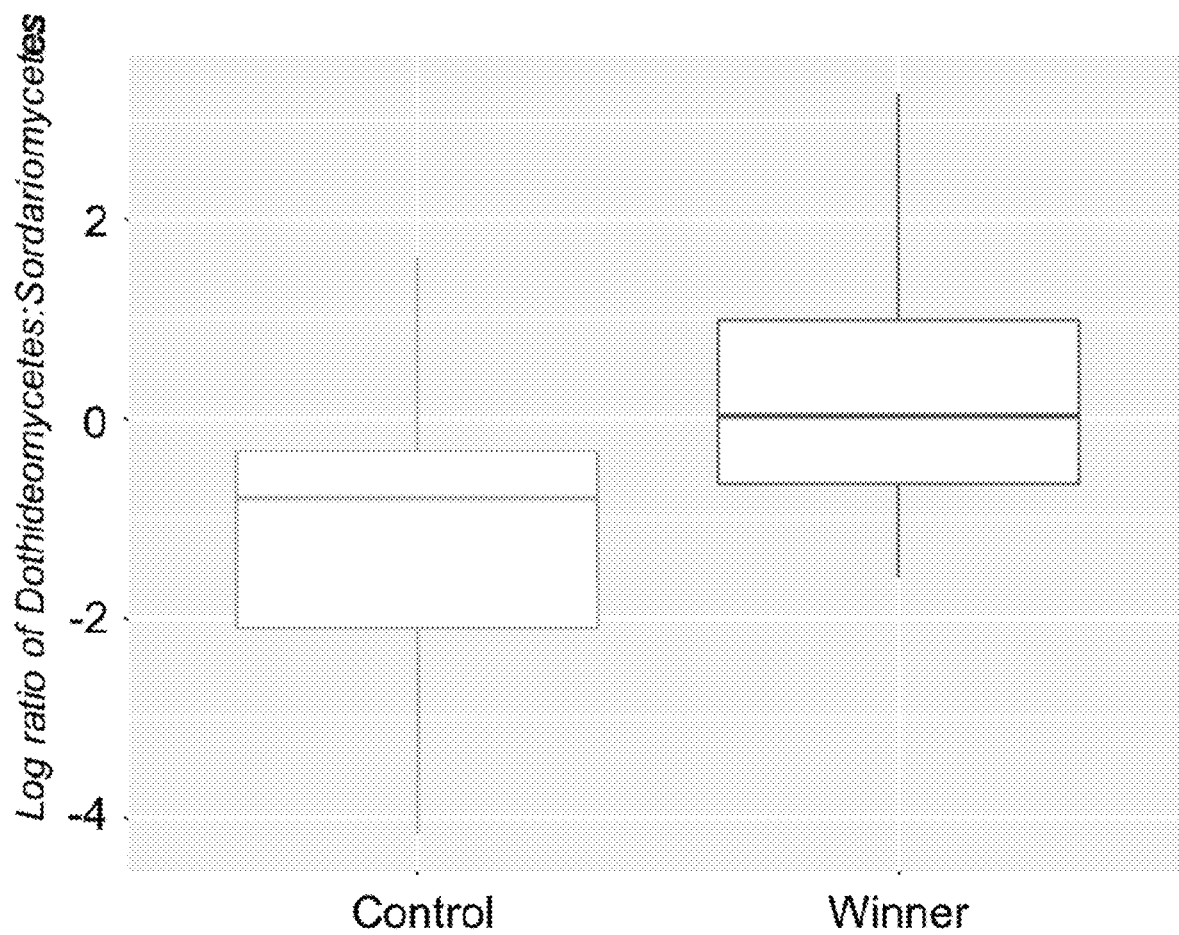
FIG. 12 shows the log ratio of the average abundance of Dothideomycetes divided by the average abundance of Sordariomycetes in the microbial communities of whole corn plants at development stage v4 under cold stress were profiled; the left boxplot shows the relative community abundance in less robust corn plants (labeled Control) and the right boxplot shows the relative community abundance in more robust corn plants (labeled Winner). The communities were profiled by ITS sequencing as described in Example 2.
Figure 13:
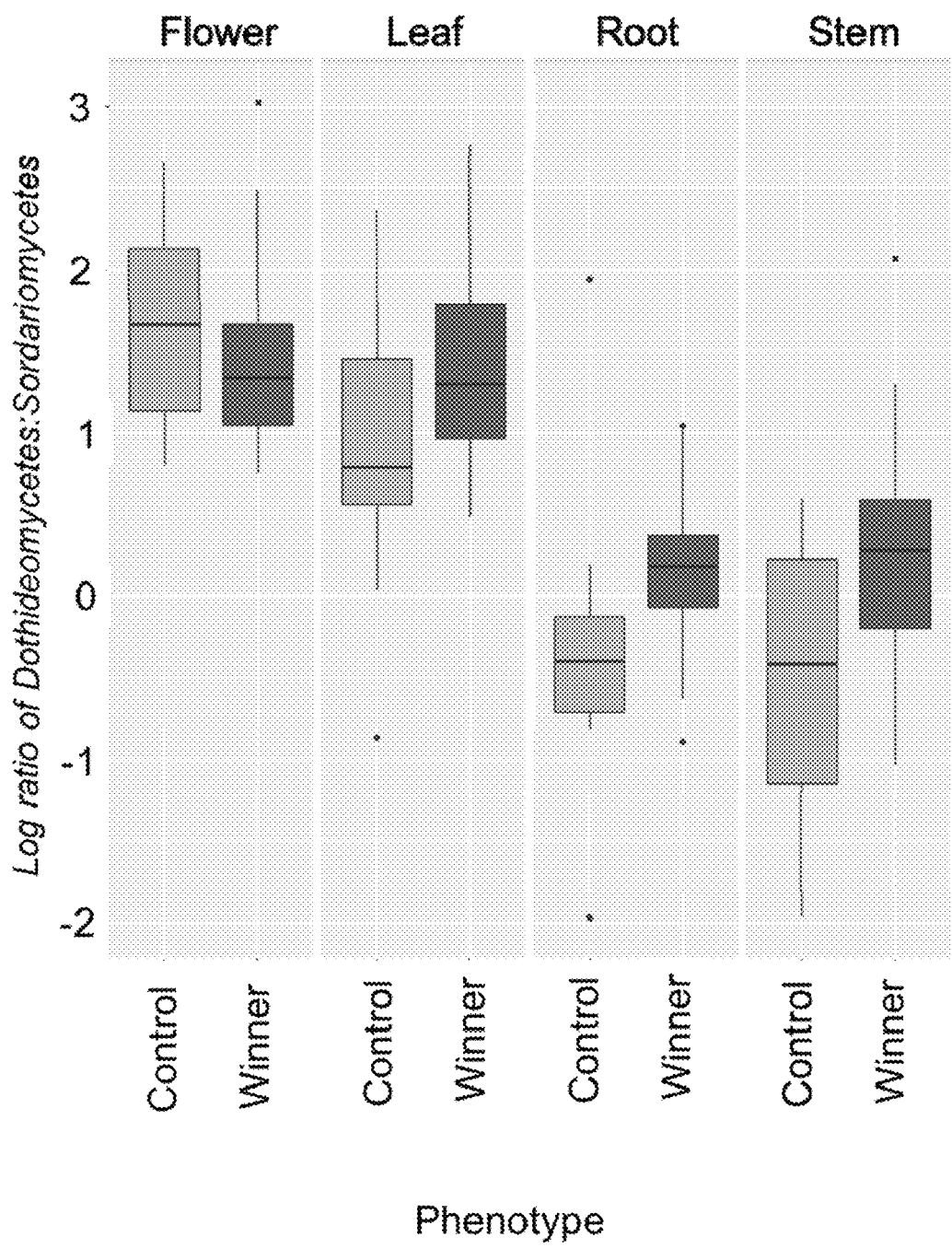
FIG. 13 shows the log ratio of the average abundance of Dothideomycetes divided by the average abundance of Sordariomycetes in the microbial communities profiled of various tissues of corn plants at development stage r1 under flood stress; each panel shows the ratio in a different tissue type, the left most boxplot in each panel shows the relative community abundance in less robust corn plants (labeled Control) and the right boxplot in each panel shows the relative community abundance in more robust corn plants (labeled Winner). The enrichment of Dothideomycetes relative to Sordariomycetes is particularly striking in the root tissue of corn plants under flood stress. The communities were profiled by ITS sequencing as described in Example 2.
Figure 14:
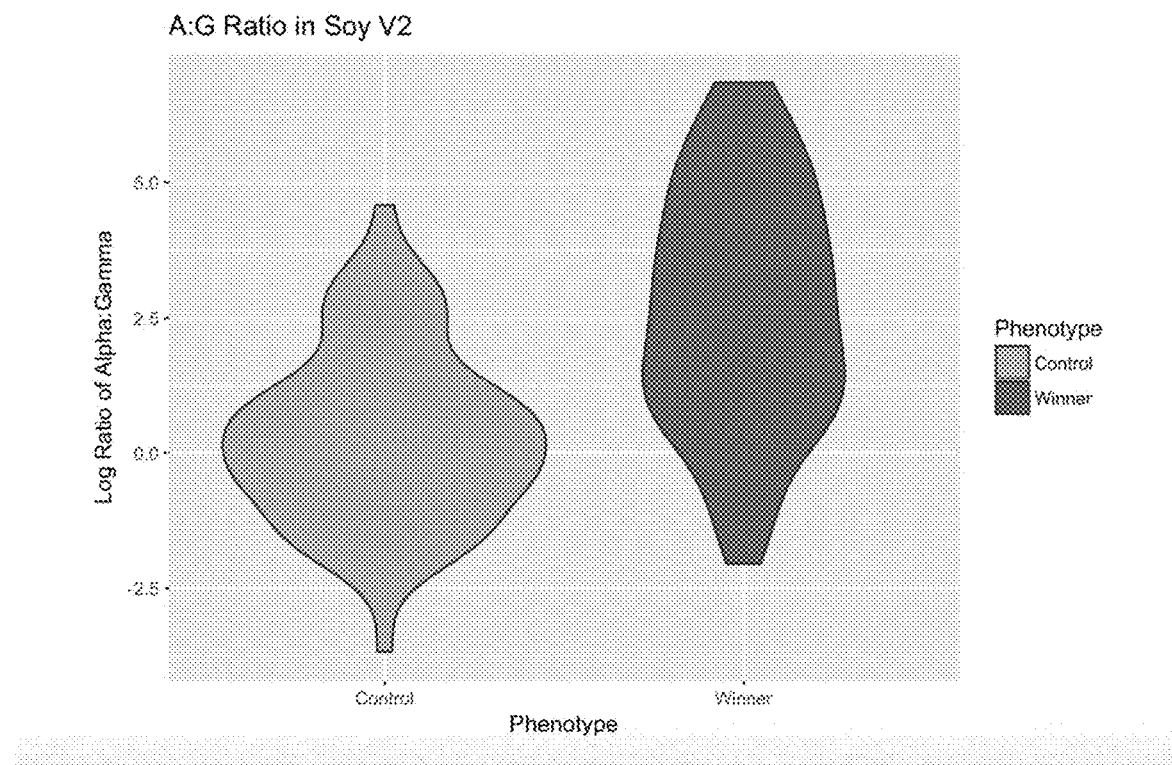
FIG. 14 shows the log ratio of the average abundance of Alphaproteobacteria divided by the average abundance of Gammaproteobacteria in the microbial communities profiled in less robust soybean plants (left plot, labeled Control) and more robust soybean plants (right plot, labeled Winner). Communities were profiled at the V2 stage. The communities were profiled by 16S sequencing as described in Example 2.
Figure 15A:
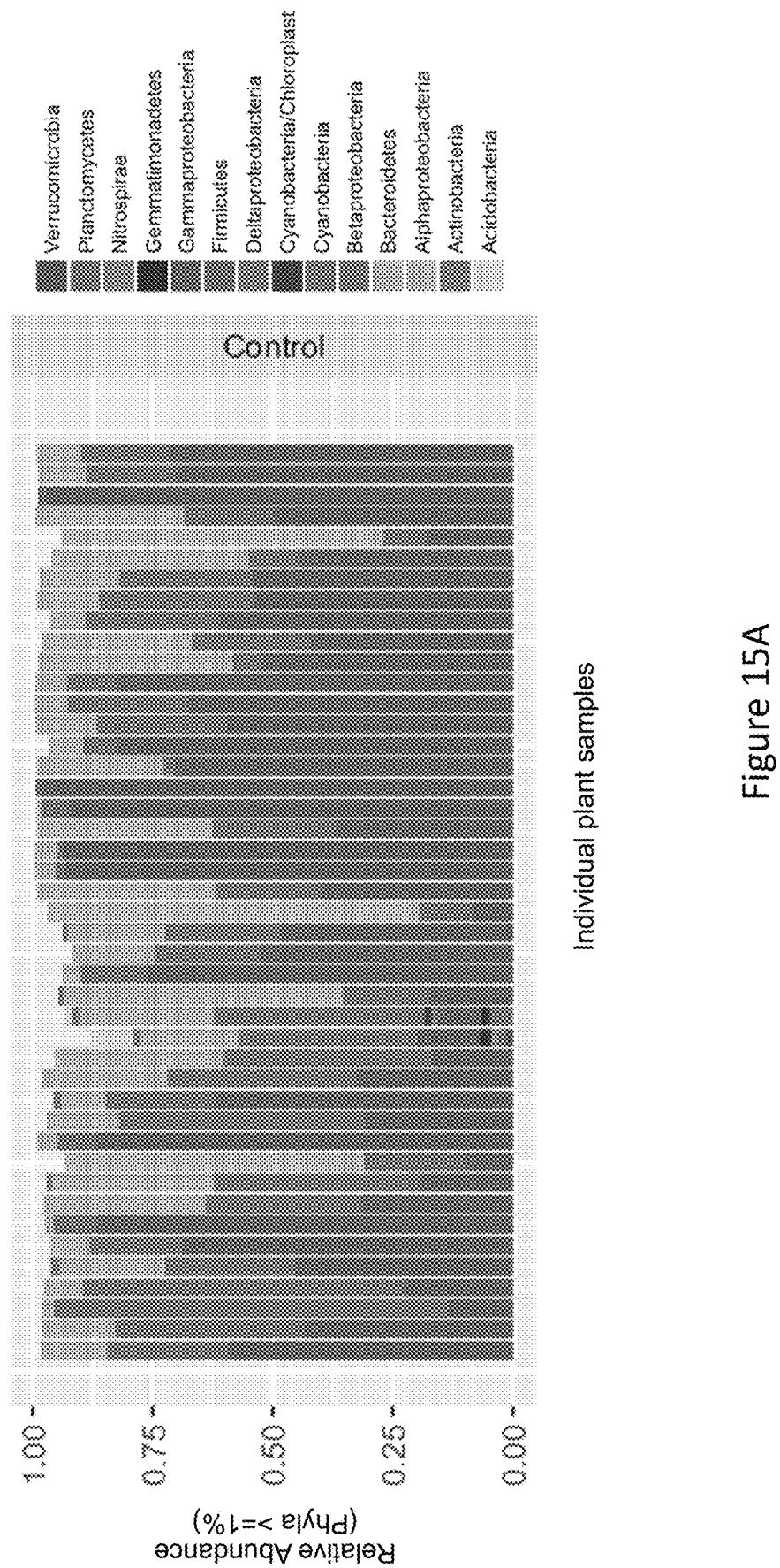
FIG. 15A shows the relative abundance of Phyla and Proteobacteria Classes in soybean plants at development stage V1 under cold stress, where the plants sampled were less robust soy plants (labeled Control).
Figure 15B:
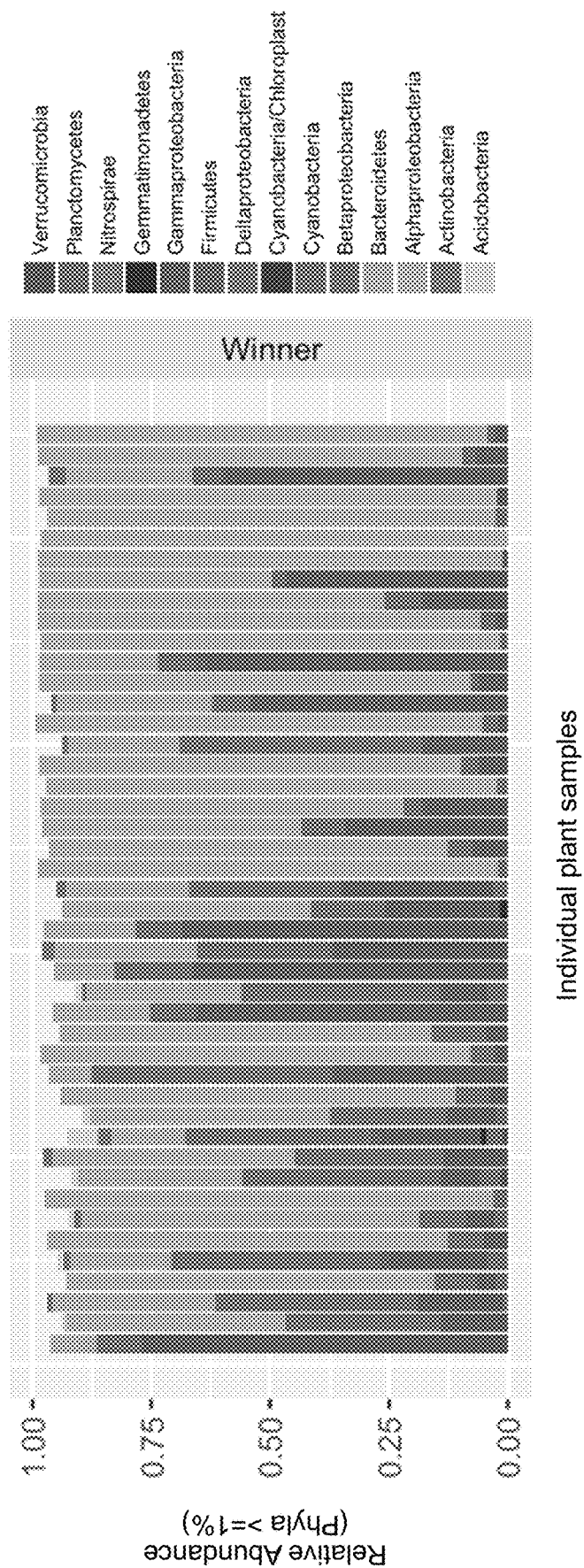
FIG. 15B shows the relative abundance of Phyla and Proteobacteria Classes in soybean plants at development stage V1 under cold stress, where the plants sampled were more robust (labeled Winner). Individual samples are displayed along the x-axis, the relative abundance of OTU in the taxonomic categories listing in the legend are shown on the y-axis. It is apparent that Alphaproteobacteria are enriched relative to Gammaproteobacteria in the microbial communities of the more robust soybean plants compared to the microbial communities of less robust plants. The communities were profiled by 16S sequencing as described in Example 2.
Figure 16A:
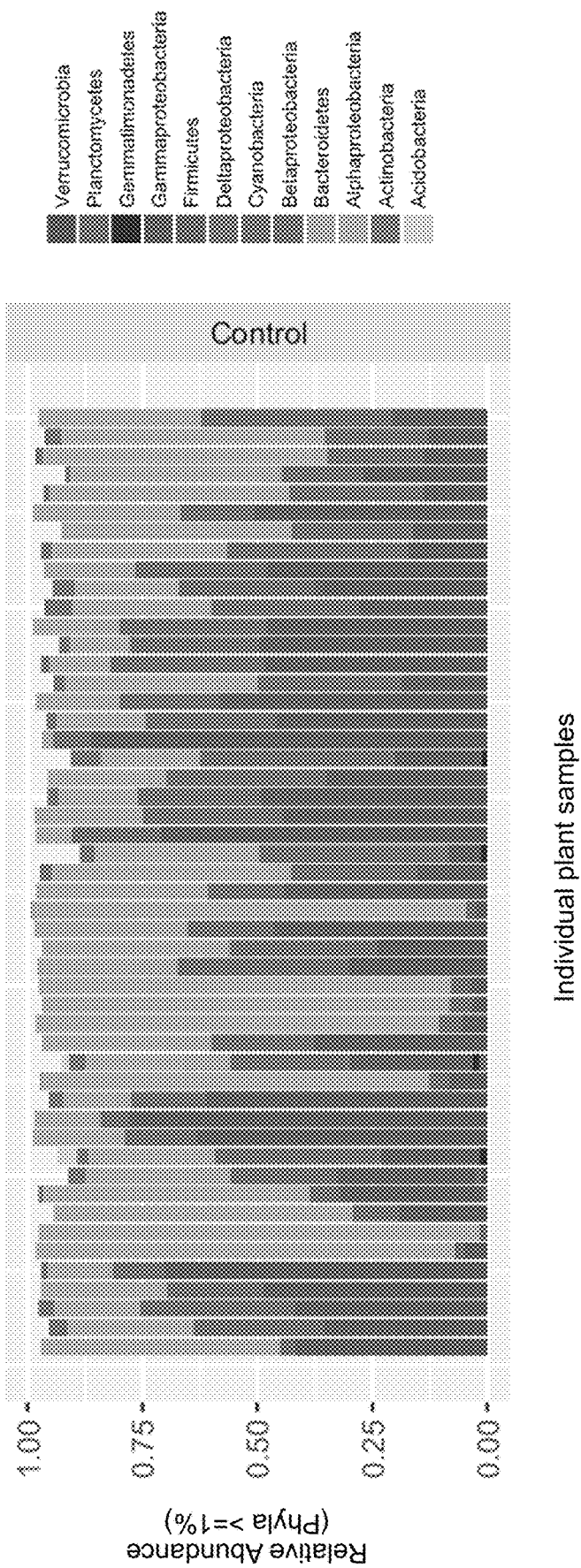
FIG. 16A shows the relative abundance of Phyla and Proteobacteria Classes in soybean plants grown under nutrient deficient conditions at stage V2, where the plants were less robust soy plants (labeled Control).
Figure 16B:
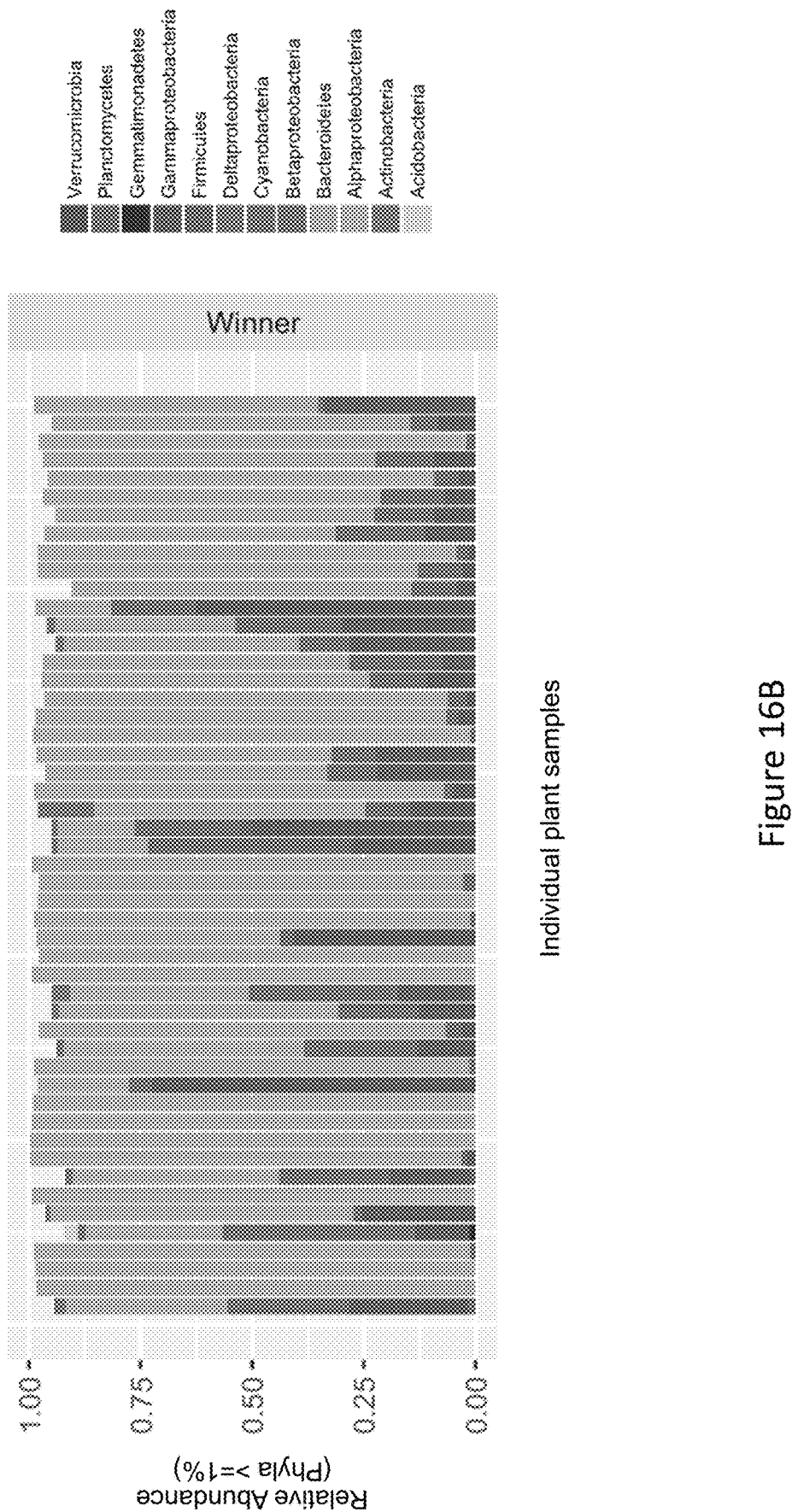
FIG. 16B shows the relative abundance of Phyla and Proteobacteria Classes in soybean plants grown under nutrient deficient conditions at stage V2, where the plants were more robust (labeled Winner). Individual samples are displayed along the x-axis, the relative abundance of OTU in the taxonomic categories listing in the legend are shown on the y-axis. It is apparent that Alphaproteobacteria are enriched relative to Gammaproteobacteria in the microbial communities of the more robust soybean plants compared to the microbial communities of less robust plants. The communities were profiled by 16S sequencing as described in Example 2.
Figure 17:
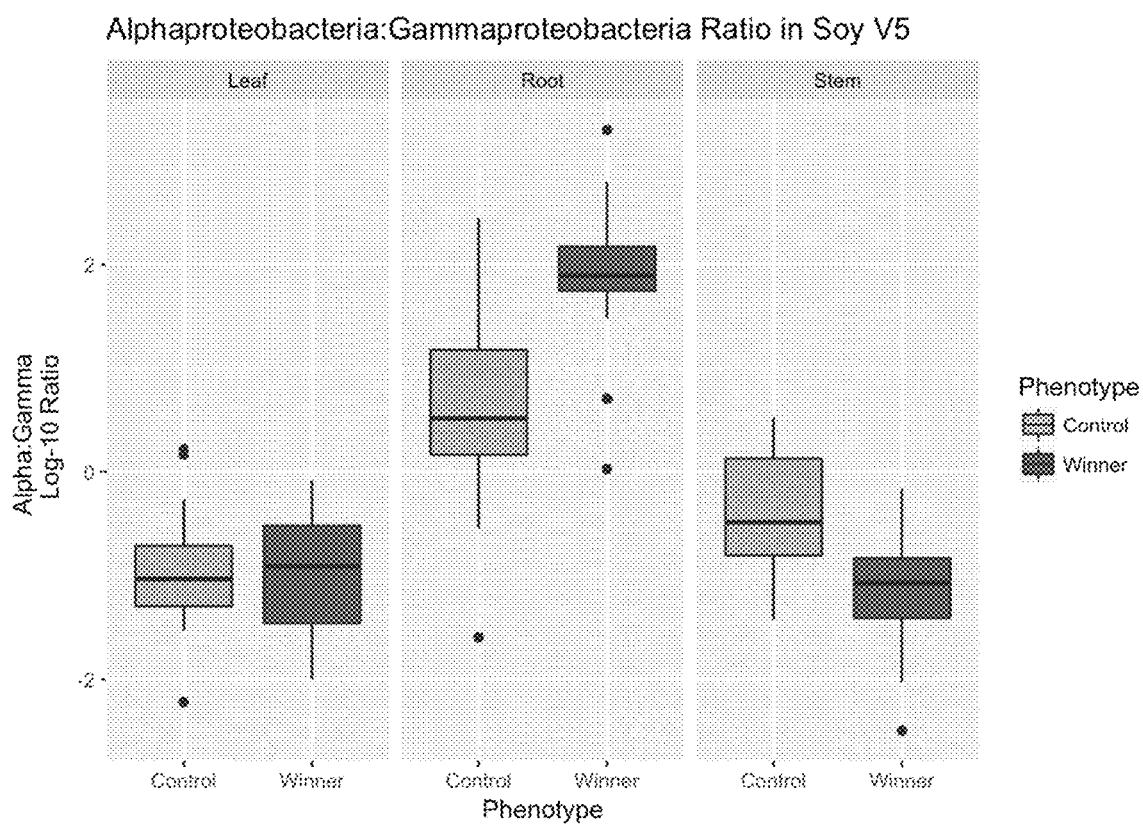
FIG. 17 shows the log ratio of the average abundance of Alphaproteobacteria divided by the average abundance of Gammaproteobacteria in the microbial communities profiled in less robust soybean plants (left plot of each panel, labeled Control) and more robust soybean plants (right plot of each panel, labeled Winner). Communities were profiled at the V5 stage. The left most panel shows the results of profiling the community in leaf tissue. The middle panel shows the results of profiling the community in root tissue. The right most panel shows the results of profiling the community in stem tissue. The communities were profiled by 16S sequencing as described in Example 2.
Figure 18:
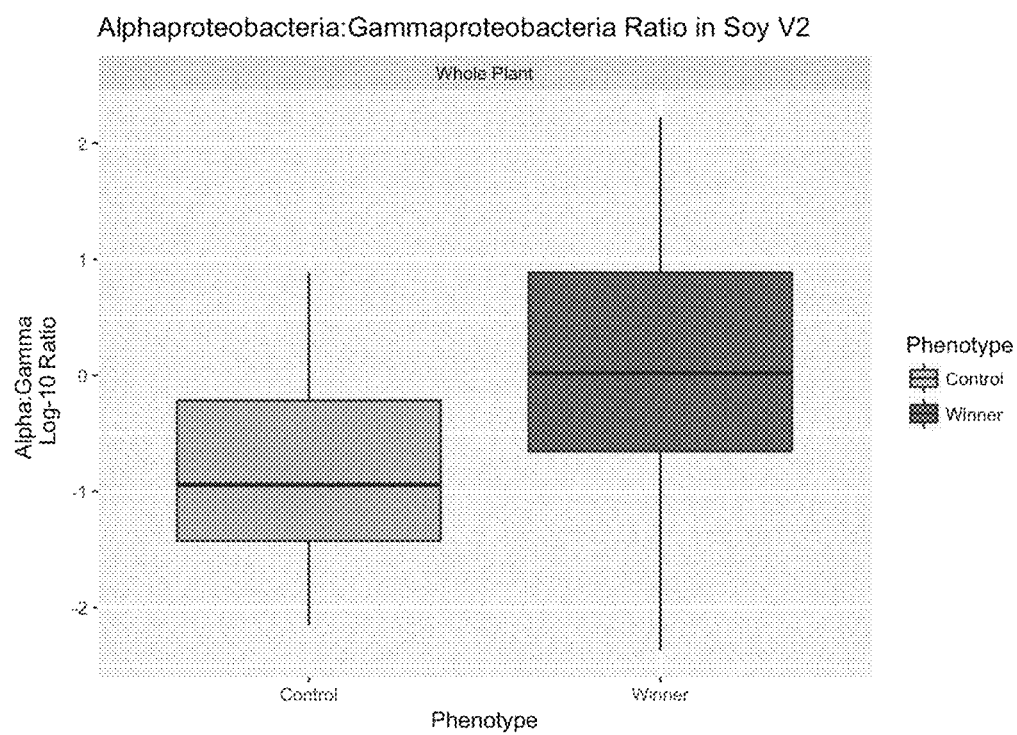
FIG. 18 shows the log ratio of the average abundance of Alphaproteobacteria divided by the average abundance of Gammaproteobacteria in the microbial communities profiled in less robust soybean plants (left plot, labeled Control) and more robust soybean plants (right plot, labeled Winner). Communities were profiled at the V2 stage. The communities were profiled by 16S sequencing as described in Example 2.

In comparing the log ratio of Alphaproteobacteria:Gammaproteobacteria between the more and less healthy plants (winners and controls, respectively) it is clear that samples from healthy plants tend to have an increased log ratio. Although this ratio is a stronger indicator in V2 soy (FIG. 8B) than V1 soy (FIG. 8A), it provides a useful indicator across both these growth stages.

Example 5. Relative Fungal Taxonomic Ratio Analysis to Detect Plant Health

Methods

The relative taxonomic ratio for any sample can be calculated by the ratio between the proportion of reads in the OTU table assigned to one taxonomic group and the proportion of reads assigned to another taxonomic group. In this method, relative taxonomic ratio analysis was applied to the fungal class Dothideomycetes and the fungal class Sordariomycetes, and then log-transformed.

Results

The relative taxonomic ratio of Dothideomycetes:Sordariomycetes was calculated for stages V2, V4, V5, V7 and R1 soy (*Glycine max*) and corn (*Zea mays*) crops. FIGS. 9-13 show the relative abundance of Dothideomycetes and Sordariomycetes classes in soybean or corn plants at stage V2, V4, V5, V7 or R1 where the plants were grown in field conditions under nutrient deficient conditions, flood conditions, or cold stress. Dothideomycetes are enriched relative to Sordariomycetes in the microbial communities of the more robust soybean plants compared to the microbial communities of less robust plants.

In comparing the log ratio of Dothideomycetes:Sordariomycetes between the more and less healthy plants (winners and controls, respectively) it is clear that samples from healthy plants tend to have an increased log ratio. This ratio is an indicator of plant health across dicot and monocot crops and across a variety of environmental growth conditions. It is a particularly strong indicator of stronger indicator in V2 soy seedlings (whole plant tissue) grown in nutrient deficient conditions (FIG. 10), V4 corn plants (whole plant tissue) grown in cold conditions (FIG. 12), V7 corn plants (root tissue) grown in cold conditions (FIG. 11), R1 corn plants (root tissue) grown in flood conditions (FIG. 13), though benefits are also seen in other tissues and conditions.

TABLE 1

Endophytes enriched in soybean plants with improved plant health

| SEQ ID NO: | Kingdom | Phylum | Class | Order | Family | Genus | Species |
|---|---|---|---|---|---|---|---|
| 8, 9, 10 | Bacteria | Proteobacteria | Alphaproteobacteria | Rhizobiales | Bradyrhizobiaceae | *Bradyrhizobium* | |
| 7 | Bacteria | Proteobacteria | Alphaproteobacteria | Rhizobiales | Methylobacteriaceae | *Methylobacterium* | |
| 5 | Bacteria | Proteobacteria | Alphaproteobacteria | Sphingomonadales | Sphingomonadaceae | *Novosphingobium* | *rosa* |
| 198 | Bacteria | Proteobacteria | Alphaproteobacteria | Sphingomonadales | Sphingomonadaceae | *Novosphingobium* | *sediminicola* |
| 200 | Bacteria | Proteobacteria | Alphaproteobacteria | Caulobacterales | Caulobacteraceae | *Phenylobacterium* | |
| 6 | Bacteria | Proteobacteria | Alphaproteobacteria | Rhizobiales | Rhizobiaceae | *Rhizobium* | *huautlense* |
| 11, 12, 13, 15, 204 | Bacteria | Proteobacteria | Alphaproteobacteria | Sphingomonadales | Sphingomonadaceae | *Sphingomonas* | |
| 14 | Bacteria | Proteobacteria | Alphanroteobacteria | Rhodobacterales | Rhodobacteraceae | | |

TABLE 2

Endophytes with reduced abundance in soybean plants with improved plant health

| SEQ ID NO: | Kingdom | Phylum | Class | Order | Family | Genus | Species |
|---|---|---|---|---|---|---|---|
| 199 | Bacteria | Proteobacteria | Alphaproteobacteria | Caulobacterales | Caulobacteraceae | *Brevundimonas* | |
| 16 | Bacteria | Proteobacteria | Alphaproteobacteria | Caulobacterales | Caulobacteraceae | *Caulobacter* | *vibrioides* |
| 22 | Bacteria | Proteobacteria | Alphaproteobacteria | Caulobacterales | Caulobacteraceae | *Caulobacter* | |
| 17 | Bacteria | Proteobacteria | Alphaproteobacteria | Rhizobiales | Methylobacteriaceae | *Methylobacterium* | *adhaesivum* |
| 21 | Bacteria | Proteobacteria | Alphaproteobacteria | Rhizobiales | Methylobacteriaceae | *Methylobacterium* | |
| 23 | Bacteria | Proteobacteria | Alphaproteobacteria | Rhizobiales | Methylobacteriaceae | *Microvirga* | |
| 197 | Bacteria | Proteobacteria | Alphaproteobacteria | Rhizobiales | Rhizobiaceae | *Agrobacterium* | *tumefaciens* |
| 24, 25, 26, 27, 29, 201, 202 | Bacteria | Proteobacteria | Alphaproteobacteria | Rhizobiales | Rhizobiaceae | *Rhizobium* | |
| 28 | Bacteria | Proteobacteria | Alphaproteobacteria | Rhizobiales | Xanthobacteraceae | *Labrys* | |
| 39 | Bacteria | Proteobacteria | Alphaproteobacteria | Rhodobacterales | Rhodobacteraceae | *Gemmobacter* | |
| 38 | Bacteria | Proteobacteria | Alphaproteobacteria | Rhodobacterales | Rhodobacteraceae | *Paracoccus* | |
| 20 | Bacteria | Proteobacteria | Alphaproteobacteria | Rhodospirillales | Rhodospirillaceae | *Inquilinus* | |
| 34 | Bacteria | Proteobacteria | Alphaproteobacteria | Sphingomonadales | Erythrobacteraceae | *Porphyrobacter* | |
| 18 | Bacteria | Proteobacteria | Alphaproteobacteria | Sphingomonadales | Sphingomonadaceae | *Novosphingobium* | *capsulatum* |
| 35 | Bacteria | Proteobacteria | Alphaproteobacteria | Sphingomonadales | Sphingomonadaceae | *Novosphingobium* | |
| 19 | Bacteria | Proteobacteria | Alphaproteobacteria | Sphingomonadales | Sphingomonadaceae | *Sphingomonas* | *kaistensis* |
| 40 | Bacteria | Proteobacteria | Alphaproteobacteria | Sphingomonadales | Sphingomonadaceae | *Sphingobium* | |
| 30, 31, 32, 33, 36, 37, 41, 42, 43, 44, 45, 46, 48, 203, 205 | Bacteria | Proteobacteria | Alphaproteobacteria | Sphingomonadales | Sphingomonadaceae | *Sphingomonas* | |
| 47 | Bacteria | Proteobacteria | Alphaproteobacteria | | | | |

TABLE 3

Endophytes enriched in corn plants with improved plant health

| SEQ ID NO: | Kingdom | Phylum | Class | Order | Family | Genus | Species |
|---|---|---|---|---|---|---|---|
| 82 | Bacteria | Acidobacteria | Acidobacteria | Subgroup_4 | Unknown_Family | *Blastocatella* | |
| 58 | Bacteria | Acidobacteria | Acidobacteria_Gp6 | Gp6 | Gp6 | Gp6 | |

TABLE 3-continued

Endophytes enriched in corn plants with improved plant health

| SEQ ID NO: | Kingdom | Phylum | Class | Order | Family | Genus | Species |
|---|---|---|---|---|---|---|---|
| 57 | Bacteria | Actinobacteria | Actinobacteria | Micromonosporales | Micromonosporaceae | *Catenuloplanes* | |
| 53 | Bacteria | Actinobacteria | Actinobacteria | Streptomycetales | Streptomycetaceae | *Streptomyces* | *indicus* |
| 105 | Bacteria | Armatimonadetes | Chthonomonadetes | Chthonomonadales | Chthonomonadaceae | *Chthonomonas/ Armatimonadetes_gp3* | |
| 51 | Bacteria | Bacteroidetes | Chitinophagia | Chitinophagales | Chitinophagaceae | *Sediminibacterium* | *salmoneum* |
| 106 | Bacteria | Bacteroidetes | Cytophagia | Cytophagales | Cytophagaceae | *Fibrella* | |
| 69 | Bacteria | Bacteroidetes | Flavobacteriia | Flavobacteriales | Flavobacteriaceae | *Flavobacterium* | |
| 79 | Bacteria | Bacteroidetes | Flavobacteriia | Flavobacteriales | Flavobacteriaceae | *Chryseobacterium* | |
| 70 | Bacteria | Bacteroidetes | Sphingobacteriia | Sphingobacteriales | Sphingobacteriaceae | *Pedobacter* | |
| 71, 72 | Bacteria | Bacteroidetes | Sphingobacteriia | Sphingobacteriales | Sphingobacteriaceae | *Sphingobacterium* | |
| 81 | Bacteria | Chloroflexi | Ktedonobacteria | C0119 | | | |
| 102 | Bacteria | Chloroflexi | TK10 | | | | |
| 56 | Bacteria | Cyanobacteria | Cyanobacteria | SubsectionIII | FamilyI | *Planktothrix* | |
| 104 | Bacteria | Cyanobacteria/ Chloroplast | Cyanobacteria | | | | |
| 101 | Bacteria | Firmicutes | Bacilli | Bacillales | Alicyclobacillaceae | *Tumebacillus* | |
| 100 | Bacteria | Firmicutes | Bacilli | Bacillales | Bacillaceae | *Bacillus* | |
| 84 | Bacteria | Firmicutes | Bacilli | Bacillales | Paenibacillaceae | *Paenibacillus* | |
| 83 | Bacteria | Firmicutes | Bacilli | Bacillales | Paenibacillaceae 2 | *Ammoniphilus* | |
| 99 | Bacteria | Firmicutes | Bacilli | Bacillales | | | |
| 55 | Bacteria | Planctomycetes | Planctomycetacia | Planctomycetales | Planctomycetaceae | | |
| 64 | Bacteria | Planctomycetes | Planctomycetacia | Planctomycetales | Planctomycetaceae | *Planctomyces* | |
| 65 | Bacteria | Proteobacteria | Alphaproteobacteria | Rhizobiales | A0839 | | |
| 50 | Bacteria | Proteobacteria | Alphaproteobacteria | Rhizobiales | Methylobacteriaceae | *Methylobacterium* | *aquaticum* |
| 73 | Bacteria | Proteobacteria | Alphaproteobacteria | Sphingomonadales | Sphingomonadaceae | *Sphingobium* | |
| 52 | Bacteria | Proteobacteria | Alphaproteobacteria | Sphingomonadales | Sphingomonadaceae | *Sphingomonas* | *jaspsi* |
| 74, 203, 204 | Bacteria | Proteobacteria | Alphaproteobacteria | Sphingomonadales | Sphingomonadaceae | *Sphingomonas* | |
| 85, 86 | Bacteria | Proteobacteria | Betaproteobacteria | Burkholderiales | Burkholderiaceae | *Ralstonia* | |
| 94 | Bacteria | Proteobacteria | Betaproteobacteria | Burkholderiales | Burkholderiaceae | *Burkholderia* | |
| 54 | Bacteria | Proteobacteria | Betaproteobacteria | Burkholderiales | Comamonadaceae | *Variovorax* | *paradoxus* |
| 87 | Bacteria | Proteobacteria | Betaproteobacteria | Burkholderiales | Comamonadaceae | | |
| 88 | Bacteria | Proteobacteria | Betaproteobacteria | Burkholderiales | Comamonadaceae | | |
| 89 | Bacteria | Proteobacteria | Betaproteobacteria | Burkholderiales | Comamonadaceae | *Pelomonas* | |
| 93 | Bacteria | Proteobacteria | Betaproteobacteria | Burkholderiales | Comamonadaceae | | |
| 90 | Bacteria | Proteobacteria | Betaproteobacteria | Burkholderiales | Oxalobacteraceae | | |
| 91, 92 | Bacteria | Proteobacteria | Betaproteobacteria | Burkholderiales | Oxalobacteraceae | *Duganella* | |
| 98 | Bacteria | Proteobacteria | Betaproteobacteria | Burkholderiales | Oxalobacteraceae | *Massilia* | |
| 95 | Bacteria | Proteobacteria | Betaproteobacteria | Burkholderiales | | | |
| 112 | Bacteria | Proteobacteria | Betaproteobacteria | Burkholderiales | | | |
| 96 | Bacteria | Proteobacteria | Betaproteobacteria | Nitrosomonadales | Nitrosomonadaceae | | |
| 97 | Bacteria | Proteobacteria | Betaproteobacteria | | | | |
| 109 | Bacteria | Proteobacteria | Betaproteobacteria | | | | |
| 110 | Bacteria | Proteobacteria | Betaproteobacteria | | | | |
| 111 | Bacteria | Proteobacteria | Betaproteobacteria | | | | |
| 113 | Bacteria | Proteobacteria | Betaproteobacteria | | | | |
| 103 | Bacteria | Proteobacteria | Deltaproteobacteria | Myxococcales | | | |
| 75 | Bacteria | Proteobacteria | Gammaproteobacteria | Enterobacteriales | Enterobacteriaceae | | |
| 76 | Bacteria | Proteobacteria | Gammaproteobacteria | Enterobacteriales | Enterobacteriaceae | *Pantoea* | |
| 77 | Bacteria | Proteobacteria | Gammaproteobacteria | Enterobacteriales | Enterobacteriaceae | | |
| 78 | Bacteria | Proteobacteria | Gammaproteobacteria | Enterobacteriales | Enterobacteriaceae | *Escherichia/Shigella* | |
| 80 | Bacteria | Proteobacteria | Gammaproteobacteria | Legionellales | Legionellaceae | *Legionella* | |
| 63 | Bacteria | Proteobacteria | Gammaproteobacteria | Pseudomonadales | Moraxellaceae | *Acinetobacter* | |
| 59, 60, 61, 62, 66, 67 | Bacteria | Proteobacteria | Gammaproteobacteria | Pseudomonadales | Pseudomonadaceae | *Pseudomonas* | |
| 68 | Bacteria | Proteobacteria | Gammaproteobacteria | Xanthomonadales | Xanthomonadaceae | *Stenotrophomonas* | |
| 49 | Bacteria | Verrucomicrobia | Spartobacteria | Chthoniobacterales | Chthoniobacteraceae | *Chthoniobacter* | *flavus* |
| 107 | NA | | | | | | |
| 108 | NA | | | | | | |

TABLE 4

Endophytes with reduced abundance in corn plants with improved plant health

| SEQ ID NO: | Kingdom | Phylum | Class | Order | Family | Genus | Species |
|---|---|---|---|---|---|---|---|
| 192 | Bacteria | Acidobacteria | Acidobacteria_Gp 16 | Gp16 | Gp16 | Gp16 | |
| 181 | Bacteria | Actinobacteria | Actinobacteria | Actinomycetales | Microbacteriaceae | | |
| 166 | Bacteria | Actinobacteria | Actinobacteria | Actinomycetales | Micrococcaceae | *Arthrobacter* | |

TABLE 4-continued

Endophytes with reduced abundance in corn plants with improved plant health

| SEQ ID NO: | Kingdom | Phylum | Class | Order | Family | Genus | Species |
|---|---|---|---|---|---|---|---|
| 158, 159 | Bacteria | Bacteroidetes | Chitinophagia | Chitinophagales | Chitinophagaceae | *Chitinophaga* | |
| 165 | Bacteria | Bacteroidetes | Cytophagia | Cytophagales | Cytophagaceae | *Dyadobacter* | |
| 140, 141, 142, 143 | Bacteria | Bacteroidetes | Flavobacteriia | Flavobacteriales | Flavobacteriaceae | *Flavobacterium* | |
| 160, 161, 162, 163, 164 | Bacteria | Bacteroidetes | Flavobacteriia | Flavobacteriales | Flavobacteriaceae | *Chryseobacterium* | |
| 119 | Bacteria | Bacteroidetes | Sphingobacteriia | Sphingobacteriales | Sphingobacteriaceae | *Mucilaginibacter* | *composti* |
| 144 | Bacteria | Bacteroidetes | Sphingobacteriia | Sphingobacteriales | Sphingobacteriaceae | *Mucilaginibacter* | |
| 120 | Bacteria | Bacteroidetes | Sphingobacteriia | Sphingobacteriales | Sphingobacteriaceae | *Pedobacter* | *tournemirensis* |
| 117 | Bacteria | Chloroflexi | Chloroflexia | Herpetosiphonales | Herpetosiphonaceae | *Herpetosiphon* | *aurantiacus* |
| 116 | Bacteria | Firmicutes | Clostridia | Clostridiales | Clostridiaceae | *Clostridium* | *acidisoli* |
| 193, 194 | Bacteria | Firmicutes | Clostridia | Clostridiales | Clostridiaceae | *Clostridium* | |
| 124 | Bacteria | Planctomycetes | Planctomycetacia | Planctomycetales | Planctomycetaceae | | |
| 130, 131 | Bacteria | Proteobacteria | Alphaproteobacteria | Caulobacterales | Caulobacteraceae | *Asticcacaulis* | |
| 199 | Bacteria | Proteobacteria | Alphaproteobacteria | Caulobacterales | Caulobacteraceae | *Brevundimonas* | |
| 200 | Bacteria | Proteobacteria | Alphaproteobacteria | Caulobacterales | Caulobacteraceae | *Phenylobacterium* | |
| 132, 133, 134, 135 | Bacteria | Proteobacteria | Alphaproteobacteria | Rhizobiales | Rhizobiaceae | *Rhizobium* | |
| 197 | Bacteria | Proteobacteria | Alphaproteobacteria | Rhizobiales | Rhizobiaceae | *Agrobacterium* | *tumefaciens* |
| 201, 202 | Bacteria | Proteobacteria | Alphaproteobacteria | Rhizobiales | Rhizobiaceae | *Rhizobium* | |
| 121 | Bacteria | Proteobacteria | Alphaproteobacteria | Sphingomonadales | Sphingomonadaceae | *Sphingomonas* | *polyaromaticivorans* |
| 205 | Bacteria | Proteobacteria | Alphaproteobacteria | Sphingomonadales | Sphingomonadaceae | *Sphingomonas* | |
| 198 | Bacteria | Proteobacteria | Alphaproteobacteria | Sphingomonadales | Sphingomonadaceae | *Novosphingobium* | *sediminicola* |
| 145, 146, 147 | Bacteria | Proteobacteria | Alphaproteobacteria | Sphingomonadales | Sphingomonadaceae | *Novosphingobium* | |
| 148, 149 | Bacteria | Proteobacteria | Alphaproteobacteria | Sphingomonadales | Sphingomonadaceae | *Sphingobium* | |
| 173 | Bacteria | Proteobacteria | Betaproteobacteria | Burkholderiales | Alcaligenaceae | | |
| 115 | Bacteria | Proteobacteria | Betaproteobacteria | Burkholderiales | Burkholderiaceae | *Burkholderia* | *soli* |
| 172, 174, 185, 187, 190, 191 | Bacteria | Proteobacteria | Betaproteobacteria | Burkholderiales | Burkholderiaceae | *Burkholderia* | |
| 169 | Bacteria | Proteobacteria | Betaproteobacteria | Burkholderiales | Comamonadaceae | *Acidovorax* | |
| 184 | Bacteria | Proteobacteria | Betaproteobacteria | Burkholderiales | Comamonadaceae | *Acidovorax* | |
| 175 | Bacteria | Proteobacteria | Betaproteobacteria | Burkholderiales | Comamonadaceae | *Comamonas* | |
| 183 | Bacteria | Proteobacteria | Betaproteobacteria | Burkholderiales | Comamonadaceae | *Simplicispira* | |
| 167, 170, 171, 176, 182 | Bacteria | Proteobacteria | Betaproteobacteria | Burkholderiales | Comamonadaceae | | |
| 177 | Bacteria | Proteobacteria | Betaproteobacteria | Burkholderiales | Oxalobacteraceae | *Duganella* | |
| 178, 196 | Bacteria | Proteobacteria | Betaproteobacteria | Burkholderiales | Oxalobacteraceae | *Massilia* | |
| 179, 180 | Bacteria | Proteobacteria | Betaproteobacteria | Burkholderiales | Oxalobacteraceae | | |
| 168 | Bacteria | Proteobacteria | Betaproteobacteria | Burkholderiales | Roseateles | | |
| 186 | Bacteria | Proteobacteria | Betaproteobacteria | Burkholderiales | | | |
| 188 | Bacteria | Proteobacteria | Betaproteobacteria | Methylophilales | Methylophilaceae | *Methylophilus* | |
| 189 | Bacteria | Proteobacteria | Betaproteobacteria | Methylophilales | Methylophilaceae | *Methylophilus* | |
| 118 | Bacteria | Proteobacteria | Betaproteobacteria | Neisseriales | Chromobacteriaceae | *Microvirgula* | *aerodenitrificans* |
| 156 | Bacteria | Proteobacteria | Gammaproteobacteria | Cellvibrionales | Cellvibrionaceae | *Cellvibrio* | |
| 150 | Bacteria | Proteobacteria | Gammaproteobacteria | Enterobacterales | Enterobacteriaceae | *Enterobacter* | |
| 154 | Bacteria | Proteobacteria | Gammaproteobacteria | Enterobacterales | Enterobacteriaceae | *Salmonella* | |
| 155 | Bacteria | Proteobacteria | Gammaproteobacteria | Enterobacterales | Enterobacteriaceae | *Yersinia* | |
| 151, 152, 153 | Bacteria | Proteobacteria | Gammaproteobacteria | Enterobacterales | Enterobacteriaceae | | |

TABLE 4-continued

Endophytes with reduced abundance in corn plants with improved plant health

| SEQ ID NO: | Kingdom | Phylum | Class | Order | Family | Genus | Species |
|---|---|---|---|---|---|---|---|
| 114 | Bacteria | Proteobacteria | Gammaproteobacteria | Pseudomonadales | Pseudomonadaceae | *Azotobacter* | *chroococcum* |
| 125, 126, 127, 128, 129, 136 | Bacteria | Proteobacteria | Gammaproteobacteria | Pseudomonadales | Pseudomonadaceae | *Pseudomonas* | |
| 157 | Bacteria | Proteobacteria | Gammaproteobacteria | Xanthomonadales | Rhodanobacteraceae | *Luteibacter* | |
| 122 | Bacteria | Proteobacteria | Gammaproteobacteria | Xanthomonadales | Xanthomonadaceae | *Thermomonas* | *haemolytica* |
| 137 | Bacteria | Proteobacteria | Gammaproteobacteria | Xanthomonadales | Xanthomonadaceae | *Pseudoxanthomonas* | |
| 138 | Bacteria | Proteobacteria | Gammaproteobacteria | Xanthomonadales | Xanthomonadaceae | *Xanthomonas* | |
| 139 | Bacteria | Proteobacteria | Gammaproteobacteria | Xanthomonadales | Xanthomonadaceae | *Stenotrophomonas* | |
| 195 | Bacteria | Proteobacteria | Gammaproteobacteria | | | | |
| 123 | Bacteria | Verrucomicrobia | Verrucomicrobiae | Verrucomicrobiales | Verrucomicrobiaceae | *Verrucomicrobium* | *spinosum* |

TABLE 5

Average number of taxonomic classifications in corn plants with improved plant health

| Taxonomic Rank | Average number of classifications in profiled communities of plants with improved plant health | Average number of classifications in profiled communities of plants with reduced plant health |
|---|---|---|
| Phylum | 4.83 | 3.04 |
| Class | 5.42 | 4.64 |
| Order | 8 | 7.6 |
| Family | 10.63 | 9.08 |
| Genus | 12.92 | 12 |

TABLE 6

Phyla of endophytes with altered abundance in corn plants with improved plant health

| | % change abundance in plants with improved plant health |
|---|---|
| Armatimonadetes | 8495% |
| Planctomycetes | 294% |
| Bacteroidetes | 44% |
| Acidobacteria | 26% |
| Verrucomicrobia | 16% |
| Firmicutes | 8% |
| Proteobacteria | −13% |
| Chloroflexi | −14% |
| Actinobacteria | −34% |

TABLE 7

Classes of endophytes with altered abundance in corn plants with improved plant health

| | % change abundance in plants with improved plant health |
|---|---|
| Deltaproteobacteria | 113708% |
| Chthonomonadetes | 8495% |
| Acidobacteria Gp6 | 3014% |
| TK10 | 2221% |
| Ktedonobacteria | 2155% |
| Bacilli | 840% |
| Spartobacteria | 478% |
| Planctomycetacia | 294% |
| Sphingobacteriia | 245% |
| Opitutae | 67% |
| Betaproteobacteria | −5% |
| Gammaproteobacteria | −16% |
| Alphaproteobacteria | −17% |
| Flavobacteriia | −20% |
| Actinobacteria | −34% |
| Cytophagia | −41% |
| Acidobacteria Gp16 | −71% |
| Chitinophagia | −77% |
| Clostridia | −94% |
| Verrucomicrobiae | −95% |
| Chloroflexia | −99% |

TABLE 8

Orders of endophytes with altered abundance in corn plants with improved plant health

| | % change abundance in plants with improved plant health |
|---|---|
| Myxococcales | 113708% |
| Legionellales | 62562% |
| Chthonomonadales | 8495% |
| Gp6 | 3014% |
| C0119 | 2155% |
| Bacillales | 840% |
| Chthoniobacterales | 478% |
| Micromonosporales | 349% |
| Planctomycetales | 294% |
| Sphingobacteriales | 245% |
| Streptomycetales | 168% |
| Opitutales | 67% |
| Nitrosomonadales | 15% |
| Sphingomonadales | 14% |
| Pseudomonadales | 7% |
| Burkholderiales | −3% |
| Enterobacteriales | −14% |
| Rhizobiales | −19% |
| Flavobacteriales | −20% |
| Cytophagales | −41% |
| Rhodocyclales | −42% |
| Rhodospirillales | −47% |

TABLE 8-continued

Orders of endophytes with altered abundance in corn plants with improved plant health

| | % change abundance in plants with improved plant health |
|---|---|
| Actinomycetales | −59% |
| Xanthomonadales | −66% |
| Neisseriales | −69% |
| Gp16 | −71% |
| Caulobacterales | −73% |
| Chitinophagales | −77% |
| Methylophilales | −79% |
| Enterobacterales | −83% |
| Cellvibrionales | −94% |
| Clostridiales | −94% |
| Verrucomicrobiales | −95% |
| Herpetosiphonales | −99% |

TABLE 9

Families of endophytes with altered abundance in corn plants with improved plant health

| | % change abundance in plants with improved plant health |
|---|---|
| Legionellaceae | 62562% |
| Paenibacillaceae 2 | 22410% |
| Chthonomonadaceae | 8495% |
| Alicyclobacillaceae | 4301% |
| Gp6 | 3014% |
| Bacillaceae | 1297% |
| Nitrosomonadaceae | 965% |
| Paenibacillaceae | 492% |
| Chthoniobacteraceae | 478% |
| Micromonosporaceae | 349% |
| Planctomycetaceae | 294% |
| Methylobacteriaceae | 266% |
| Sphingobacteriaceae | 245% |
| Moraxellaceae | 238% |
| Streptomycetaceae | 116% |
| Hyphomicrobiaceae | 86% |
| Bradyrhizobiaceae | 69% |
| Opitutaceae | 67% |
| Comamonadaceae | 28% |
| Sphingomonadaceae | 14% |
| Oxalobacteraceae | 0% |
| Pseudomonadaceae | 0% |
| Enterobacteriaceae | −16% |
| Burkholderiaceae | −19% |
| Flavobacteriaceae | −20% |
| Neisseriaceae | −27% |
| Cytophagaceae | −41% |
| Rhodocyclaceae | −42% |
| Rhizobiaceae | −42% |
| Rhodospirillaceae | −47% |
| Xanthomonadaceae | −65% |
| Rhodanobacteraceae | −68% |
| Gp16 | −71% |
| Methylophilaceae | −72% |
| Caulobacteraceae | −73% |
| Chitinophagaceae | −77% |
| Chromobacteriaceae | −78% |
| Microbacteriaceae | −78% |
| Micrococcaceae | −79% |
| Alcaligenaceae | −80% |
| Roseateles | −86% |
| Cellvibrionaceae | −94% |
| Clostridiaceae | −94% |
| Verrucomicrobiaceae | −95% |
| Herpetosiphonaceae | −99% |

TABLE 10

Genera of endophytes with altered abundance in corn plants with improved plant health

| | % change abundance in plants with improved plant health |
|---|---|
| Legionella | 62562% |
| Ammoniphilus | 22410% |
| Chthonomonas/Armatimonadetes gp3 | 8495% |
| Planctomyces | 6757% |
| Sediminibacterium | 5831% |
| Tumebacillus | 4301% |
| Gp6 | 3014% |
| Pedobacter | 1598% |
| Bacillus | 1297% |
| Paenibacillus | 492% |
| Chthoniobacter | 478% |
| Catenuloplanes | 349% |
| Fibrella | 340% |
| Methylobacterium | 266% |
| Sphingomonas | 250% |
| Acinetobacter | 238% |
| Ralstonia | 200% |
| Duganella | 179% |
| Escherichia/Shigella | 177% |
| Variovorax | 176% |
| Pelomonas | 160% |
| Streptomyces | 116% |
| Sphingobacterium | 98% |
| Devosia | 86% |
| Herbaspirillum | 72% |
| Bradyrhizobium | 69% |
| Opitutus | 67% |
| Pantoea | 44% |
| Pseudomonas | 4% |
| Flavobacterium | −8% |
| Chryseobacterium | −26% |
| Sphingobium | −28% |
| Rhizobium | −31% |
| Methylovorus | −34% |
| Arenimonas | −38% |
| Acidovorax | −42% |
| Stenotrophomonas | −43% |
| Massilia | −45% |
| Azospirillum | −47% |
| Asticcacaulis | −66% |
| Luteibacter | −68% |
| Gp16 | −71% |
| Thermomonas | −75% |
| Microvirgula | −78% |
| Arthrobacter | −79% |
| Methylophilus | −79% |
| Mucilaginibacter | −79% |
| Enterobacter | −83% |
| Brevundimonas | −83% |
| Burkholderia | −84% |
| Yersinia | −85% |
| Dyadobacter | −87% |
| Phenylobacterium | −87% |
| Pseudoxanthomonas | −87% |
| Xanthomonas | −91% |
| Chitinophaga | −92% |
| Novosphingobium | −93% |
| Cellvibrio | −94% |
| Clostridium | −94% |
| Azotobacter | −94% |
| Verrucomicrobium | −95% |
| Salmonella | −98% |
| Comamonas | −98% |
| Herpetosiphon | −99% |
| Agrobacterium | −99% |
| Simplicispira | −99% |

Example 6: Differential Microbial Abundance Associated with Plant Health

Microbial communities isolated were initially profiled as described in Example 2 from plants collected according to the methods of Example 1.

Analysis of Microbial Abundance Data

DESeq (Anders S, Huber W. Differential expression analysis for sequence count data. Genome Biology. 2010; 11(10):R106. doi:10.1186/gb-2010-11-10-r106.) was used to model the raw read counts across samples for each OTU using a negative binomial distribution, estimating an OTU-specific dispersion parameter by modeling the dependence of the dispersion on the average abundance across samples. Once all samples were modeled in this fashion, the effect of the phenotype was modeled, and the log 2 fold change (LFC) between the samples of the two phenotypes was estimated (McMurdie P J, Holmes S (2014) Waste Not, Want Not: Why Rarefying Microbiome Data Is Inadmissible. PLOS Computational Biology 10(4): e1003531.). The fit of the DESeq model was verified by visual inspection of the dispersion plot. OTUs that were significantly differentially abundant between the winner and control phenotypes were identified and ordered by taxonomic classification.

The differences in microbial abundance were also analyzed through feature selection using classifiers, the goal of this analysis was to identify OTUs (also referred to as features) with abundances that are predictive of the phenotype of plant health.

A generalized linear model with penalized maximum likelihood was used to identify OTU with abundances that are predictive of plant health. The classifier was built using a specialized version of penalized logistic regression called an "elastic net". The elastic net parameter set was set to one which shrinks many of the coefficients on non-informative features to zero. The logistic regression model was fit for various values of penalization (A) on our model parameters, and model performance was reviewed. The model was also cross-validated using a dataset that the model was not trained on. The optimal model complexity was that which minimized the classification error. To implement the generalized linear models with penalized likelihood on the data, the R package 'glmnet' (Friedman J., Hastie T., & Tibshirani R. (2010). Regularization Paths for Generalized Linear Models via Coordinate Descent. Journal of Statistical Software, 33(1), 1-22) was used.

A random forest classifier was also used to identify OTUs (features) with abundances that are predictive of the phenotype of plant health. A significant advantage of random forest classifiers is that they are able to capture non-linear patterns in the features of large datasets, which is an important aspect of the effect of microbial communities on plant phenotype. Since the OTUs are subsampled in each tree generated, it is also possible to evaluate the importance of each OTUs in producing predictive decision trees. Specifically, the importance of an OTU was measured by its contribution to the mean decreased Gini index; the Gini index is a measure of the impurity or heterogeneity of phenotype among clustered samples. An OTU is useful in classifying samples according to the plant health phenotype if the inclusion of the OTU tend to split nodes containing both healthy and unhealthy samples into nodes containing samples of a single plant phenotype. A decrease in Gini impurity leads to better separation of the more and less healthy plants (winners and controls, respectively) in the decision trees.

Notable endophytes associated with plant health across multiple crops, environmental stresses, tissues and/or plant developmental stages include members of the Enterobacteriaceae family including SEQ ID NOs: 228-231, 379-386, 435-443 and 475-481; and SEQ ID NOs: 279-281, 391, 451-456 and 554-563; and members of the *Bradyrhizobium* genus including SEQ ID NOs: 253, 254 and 519-527, and SEQ ID NOs: 551-518; and members of the *Acinetobacter* genus including SEQ ID NOs: 232-235 and 482; and members of the *Arthrobacter* genus including SEQ ID NOs: 236-248 and 483-510; and members of the *Fusarium* genus including SEQ ID NOs: 293-305 and 569; and members of the *Sporidiobolus* genus including SEQ ID NOs: 314 and 573; and members of the *Macrophomina* genus including SEQ ID NOs: 317-331 and 575-587; and members of the *Phoma* genus including SEQ ID NOs: 332 and 588; and members of the *Alternaria* genus including SEQ ID NOs: 335-364, 392-434, 460-462, and 589-630; and members of the *Epicoccum* genus including SEQ ID NOs: 368-376, 463-474, and 631-636.

Bacteria and fungi or microbial OTU that are positive predictors of plant health are listed in Table 11. The column headings for Table 11 are more fully described here. The column heading "Crop" indicates the crop for which the indicated microbe is a positive predictor of plant health. The column heading "Env." indicates the environmental condition in which plant health is improved. The column "Dev." indicates a plant development stage where the microbe is present (this does not indicate that this is the only stage at which the microbe is present) v1 is the first vegetative stage, v2 is the second vegetative stage, v3 is the third vegetative stage, v4 is the fourth vegetative stage, v5 is the fifth vegetative stage, v6 is the sixth vegetative stage, v7 is the seventh vegetative stage, r1 is the first reproductive stage, r2 is the second reproductive stage. The column "Tissue" indicates a plant element where the microbe is present (this does not indicate that this is the only plant element of the plant in which the microbe is present). The sequence identifiers by which the microbes may be identified are listed in the column headed "SEQ ID NOs". The column headed "Genus" indicates the genus of the microbes. The column "Mean Abundance" indicates the relative abundance of the microbial OTU across samples. The column "log 2 Fold Change" indicates the log 2 fold change (LFC) between the samples of the two phenotypes (larger and more robust plants also referred to as "winners" and unhealthy plants, which are smaller, less green and less vibrant also referred to as "controls"). The column "adjusted p-value" shows the p-value adjusted as part of multiple comparison testing. The column "DeSeq Rank" shows the relative ranking of the microbes according to the DeSeq analysis described above. The column "Normalized Beta Co-efficients" indicates the Normalized Beta Co-efficients of the generalized linear model described above. The column "GLM rank" shows the relative ranking of the microbes according to the generalized linear model described above. The column "Mean Decrease Gini" shows the contribution of each microbe to the mean decreased Gini index. The column "Random Forest Rank" shows the ranking of the microbes according to the random forest classifier described above. The column "Ensemble Rank" shows the ranking of the microbes according to the three methods described above.

TABLE 11

Microbial OTU that are positive predictors of plant health

| Crop | Env. | Dev. | Tissue | SEQ ID NOS: | Genus | Mean Abundance | log2 Fold Change | adjusted p-value | DeSeq Rank | Normalized Beta Co-efficients | GLM rank | Mean Decrease Gini | Random Forest Rank | Ensemble Rank |
|---|---|---|---|---|---|---|---|---|---|---|---|---|---|---|
| Corn | Cold | v4 | Whole Plant | 66 | Pseudomonas | 0.01223573 | 6.61024819 | 3.95E-14 | 4 | 0.03823566 | 10 | 0.55907168 | 2 | 0.001836337 |
| | | | | 79 | Chryseobacterium | 0.00181407 | 2.91361721 | 0.00021158 | 57 | 0.16068136 | 3 | 0.14430533 | 33 | 0.010673706 |
| | | | | 109 | | 0.00375567 | 23.6407205 | 2.64E-27 | 2 | 0 | 18 | 0.09718582 | 56 | 1.006656483 |
| | | | | 283; 284; 285; 286; 287; 288; 457; 458; 459; 564; 565; 566; 567; 568; 204 | Sphingomonas | 0.0060395 | 3.12221642 | 0.00263255 | 89 | 0 | 18 | 0.31957742 | 4 | 1.010673469 |
| Soy | | v1 | | 274; 389; 390; 548; 549; 550; 551; 552; 86 | Ralstonia | 0.0027396 | 1.91367973 | 6.05E-09 | 16 | 0.07542433 | 8 | 0.64610492 | 2 | 0.002984047 |
| Soy | Cold | v1 | Whole Plant | 78 | Escherichia/Shigella | 0.01040389 | 1.77025408 | 5.99E-08 | 24 | 0.01201848 | 26 | 0.05666906 | 223 | 0.031332492 |
| | | | | 249 | Sphingomonas | 0.00021898 | 4.3350923 | 1.39E-06 | 37 | 0.03019138 | 14 | 0.05024457 | 251 | 0.034660852 |
| | | | | 188 | Methylophilus | 0.00586207 | 0.63650049 | 0.17823808 | 290 | 0.02959138 | 16 | 0.05619512 | 227 | 0.06117296 |
| | | | | 511; 512; 513; 514; 515; 516; 517; 518 | Bradyrhizobium | 3.44E-05 | 0 | 1 | 508 | 0.05918176 | 10 | 0.45721332 | 8 | 1.002059187 |
| | | v5 | Leaf | 253; 254; 519; 520; 521; 522; 523; 524; 525; 526; 527; 8 | Bradyrhizobium | 0.03972439 | 1.91210691 | 0.03681266 | 10 | 0.24124406 | 1 | 0.37595269 | 4 | 0.002124646 |
| Corn | | v7 | | 290; 139 | Stenotrophomonas | 0.00273547 | 3.43310993 | 0.01235932 | 6 | 0.10390576 | 9 | 0.50818068 | 1 | 0.002266289 |
| | | | | 253; 254; 519; 520; 521; 522; 523; 524; 525; 526; 527; 8 | Bradyrhizobium | 0.03815741 | 2.13617561 | 0.03008285 | 9 | 0.01804007 | 23 | 0.18730606 | 11 | 0.006090652 |
| | | | | 279; 280; 281; 391; 451; 452; 453; 454; 455; 456; 554; 555; 556; 557; 558; 559; 560; 561; 562; 563; 76 | Pantoea | 0.06883649 | 2.49716591 | 0.00903349 | 5 | 0 | 27 | 0.18820855 | 10 | 1.002124104 |
| Corn | Cold | v7 | Leaf | 267; 268; 269; 270; 271; 448; 449; 450; 537; 538; 539; 540; 541; 542; 543; 544; 545; 127 | Pseudomonas | 0.00119595 | 3.66174174 | 0.00175797 | 4 | 0 | 27 | 0.15955898 | 18 | 1.003115606 |
| | | | Root | 265 | Anaeromyxobacter | 0.00016857 | 2.98060306 | 3.78E-07 | 12 | 0.15007207 | 6 | 0.23223762 | 9 | 0.003827073 |
| | | | | 236; 237; 238; 239; 240; 241; 242; 243; 244; 245; 246; 247; 248; 483; 484; 485; 486; 487; 488; 489; 490; 491; 492; 493; 494; 495; 496; 497; 498; 499; 500; 501; 502; 503; 504; 505; | Arthrobacter | 0.0049233 | 2.08040729 | 3.35E-08 | 7 | 0.20548826 | 2 | 0.13489511 | 31 | 0.005669738 |

TABLE 11-continued

Microbial OTU that are positive predictors of plant health

| Crop | Env. | Dev. | Tissue | SEQ ID NOS: | Genus | Mean Abundance | log2 Fold Change | adjusted p-value | DeSeq Rank | Normalized Beta Co-efficients | GLM rank | Mean Decrease Gini | Random Forest Rank | Ensemble Rank |
|---|---|---|---|---|---|---|---|---|---|---|---|---|---|---|
| | | | | 506; 507; 508; 509; 510; 166 | | | | | | | | | | |
| | | | Stem | 292 | Asteroleplasma | 0.00106848 | 1.4887348 | 0.01202732 | 161 | 0.02264784 | 6 | 0.0961 | 64 | 0.032742736 |
| | | | | 232; 233; 234; 235; 482 | Acinetobacter | 0.05372441 | 5.7818381 | 4.90E-09 | 3 | 0 | 2 | 0.3675735 | 3 | 1.000849818 |
| Corn | | v7 | Stem | 228; 229; 230; 231; 379; 380; 381; 382; 383; 384; 385; 386; 435; 436; 437; 438; 439; 440; 441; 442; 443; 475; 476; 477; 478; 479; 480; 481; 153 | | 0.05375587 | 2.11284688 | 0.01444561 | 8 | 0 | 2 | 0.25237112 | 6 | 1.001982963 |
| | | | | 278 | Azospirillum | 0.0140776 | 5.24647269 | 3.70E-05 | 5 | 0 | 2 | 0.20732112 | 10 | 1.002124606 |
| | | | | 253; 254; 519; 520; 521; 522; 523; 524; 525; 526; 527; 8 | Bradyrhizobium | 0.04938292 | 4.95758284 | 6.91E-13 | 1 | 0 | 2 | 0.15672943 | 15 | 1.002266249 |
| | | | | 262; 263; 387; 388; 530; 531; 532; 533; 534; 85 | Ralstonia | 0.0289159 | 2.0621037 | 0.03099834 | 10 | 0 | 2 | 0.17396824 | 11 | 1.002974464 |
| | | | Leaf | 228; 229; 230; 231; 379; 380; 381; 382; 383; 384; 385; 386; 435; 436; 437; 438; 439; 440; 441; 442; 443; 475; 476; 477; 478; 479; 480; 481; 153 | | 0.05062429 | 3.77262942 | 3.00E-06 | 3 | 0 | 2 | 0.32669428 | 4 | 1.000991461 |
| | | | | 262; 263; 387; 388; 530; 531; 532; 533; 534; 85 | Ralstonia | 0.00943417 | 3.88533606 | 1.03E-05 | 7 | 0 | 2 | 0.33945165 | 3 | 1.00141639 |
| Corn | Cold | v7 | Leaf | 72 | Sphingobacterium | 0.00859544 | 6.02777556 | 9.32E-06 | 4 | 0 | 2 | 0.19514268 | 9 | 1.00184132 |
| | | | | 232; 233; 234; 235; 482 | Acinetobacter | 0.04651298 | 5.85473987 | 7.02E-08 | 2 | 0 | 2 | 0.14196793 | 14 | 1.002266249 |
| | | | | 264; 444; 445; 446; 447; 535; 536 | Stenotrophomonas | 0.09675186 | 2.64279487 | 0.00396748 | 9 | 0 | 2 | 0.21631703 | 7 | 1.002266249 |
| | | | | 283; 284; 285; 286; 287; 288; 457; 458; 459; 564; 565; 566; 567; 568; 204 | Sphingomonas | 0.07891259 | 4.11947658 | 9.32E-06 | 6 | 0 | 2 | 0.16948299 | 13 | 1.002691178 |
| | | | | 279; 280; 281; 391; 451; 452; 453; 454; 455; 456; 554; 555; 556; 557; 558; 559; 560; 561; 562; 563; 76 | Pantoea | 0.02886302 | 4.55565653 | 9.32E-06 | 5 | 0 | 2 | 0.12355628 | 19 | 1.003399393 |

TABLE 11-continued

Microbial OTU that are positive predictors of plant health

| Crop | Env. | Dev. | Tissue | SEQ ID NOS: | Genus | Mean Abundance | log2 Fold Change | adjusted p-value | DeSeq Rank | Normalized Beta Co-efficients | GLM rank | Mean Decrease Gini | Random Forest Rank | Ensemble Rank |
|---|---|---|---|---|---|---|---|---|---|---|---|---|---|---|
| Soy | | v5 | Stem | 264; 444; 445; 446; 447; 535; 536 | Stenotrophomonas | 0.06348839 | 5.31534819 | 2.36E-11 | 10 | 0.18695993 | 15 | 0.18022658 | 27 | 0.007365439 |
| | | | | 262; 263; 387; 388; 530; 531; 532; 533; 534; 85 | Ralstonia | 0.00546378 | 2.74969258 | 5.87E-05 | 44 | 0.02007882 | 30 | 0.14900404 | 34 | 0.01529745 |
| Soy | Cold | v5 | Stem | 553; 73 | Sphingobium | 0.00048996 | 1.54190198 | 0.00864962 | 96 | 0.41522001 | 3 | 0.21136182 | 23 | 0.017280453 |
| | | | | 78 | Escherichia/Shigella | 0.2929949 | 1.1093618 | 0.00086035 | 63 | 0.22422962 | 10 | 0.10939117 | 58 | 0.018555241 |
| | | | | 274; 389; 390; 548; 549; 550; 551; 552; 86 | Ralstonia | 0.06334996 | 1.18528839 | 0.00126456 | 69 | 0.78405771 | 1 | 0.07499518 | 91 | 0.022804533 |
| | | | Root | 547; 54 | Variovorax | 0.0034738 | 1.31076771 | 0.0113762 | 99 | 0.11881732 | 19 | 0.10889605 | 59 | 0.025070822 |
| | | | | 546 | Bradyrhizobium | 7.46E-05 | 3.31128906 | 2.45E-08 | 3 | 1.18054246 | 1 | 0.40111107 | 6 | 0.001417434 |
| | | | | 528 | Bradyrhizobium | 0.00010024 | 2.44642247 | 2.64E-05 | 27 | 0.03281858 | 2 | 0.25890156 | 12 | 0.005811481 |
| | | | | 529 | Bradyrhizobium | 7.81E-05 | 2.21761662 | 4.73E-05 | 30 | 0.02928605 | 3 | 0.02011905 | 236 | 0.038128987 |
| Corn | Drought | r2 | Root | 274; 389; 390; 548; 549; 550; 551; 552; 86 | Ralstonia | 0.0004045 | 4.23113311 | 5.75E-06 | 8 | 0.32340688 | 1 | 0.30391026 | 1 | 0.001955417 |
| | | | Stem | 251 | Asteroleplasma | 0.00102049 | 1.15582206 | 0.19655376 | 273 | 0.08888507 | 3 | 0.06734007 | 121 | 0.077630035 |
| | | | | 274; 389; 390; 548; 549; 550; 551; 552; 86 | Ralstonia | 0.00318493 | 7.1962522 | 6.43E-17 | 1 | 0.19517767 | 5 | 0.71313047 | 1 | 0.001365055 |
| | | | | 250 | Variovorax | 0.00536426 | 3.4168992 | 2.17E-07 | 7 | 0.28509322 | 3 | 0.43060587 | 6 | 0.003120125 |
| | | | | 273; 26 | Rhizobium | 0.05769262 | 3.00276022 | 1.21E-06 | 14 | 0.91256078 | 1 | 0.53925412 | 4 | 0.003705148 |
| | | | | 283; 284; 285; 286; 287; 288; 457; 458; 459; 564; 565; 566; 567; 568; 204 | Sphingomonas | 0.06939373 | 2.76430425 | 5.98E-07 | 11 | 0.16338131 | 6 | 0.26239722 | 12 | 0.005655226 |
| Corn | Drought | r2 | Stem | 277 | Aureimonas | 0.00107724 | 1.78490313 | 0.02867433 | 53 | 0.23359642 | 4 | 0.28641579 | 10 | 0.013065523 |
| | | | | 93 | Stenotrophomonas | 0.00553646 | 5.77943079 | 3.50E-10 | 3 | 0 | 20 | 0.55883072 | 3 | 1.001169286 |
| | | | | 252 | Sphingomonas | 0.0187194 | 6.67524658 | 4.74E-08 | 5 | 0 | 20 | 0.24332392 | 13 | 1.00350938 |
| | | | | 276; 205 | | 0.01267414 | 3.83840924 | 7.83E-05 | 18 | 0 | 20 | 0.27849729 | 11 | 1.005654466 |
| | Flood | r1 | Root | 236; 237; 238; 239; 240; 241; 242; 243; 244; 245; 246; 247; 248; 483; 484; 485; 486; 487; 488; 489; 490; 491; 492; 493; 494; 495; 496; 497; 498; 499; 500; 501; 502; 503; 504; 505; 506; 507; 508; 509; 510; 166 | Arthrobacter | 0.01225425 | 3.05838908 | 3.81E-08 | 5 | 0.23257079 | 4 | 0.12368414 | 25 | 0.006648416 |
| Corn | Flood | r1 | Leaf | 257 | Pseudomonas | 0.00590103 | 6.06548525 | 7.53E-10 | 3 | 0.07252314 | 13 | 0.042 | 155 | 0.033437622 |
| | | | | 282; 59 | Pseudomonas | 0.00081042 | 4.83425564 | 4.99E-10 | 5 | 0.3389204 | 1 | 0.80433208 | 1 | 0.001365055 |
| | | | Leaf | 236; 237; 238; 239; 240; 241; 242; 243; 244; 245; 246; 247; | Arthrobacter | 0.00175584 | 5.43380585 | 9.64E-08 | 7 | 0.31588457 | 2 | 0.49090926 | 3 | 0.002340094 |

TABLE 11-continued

Microbial OTU that are positive predictors of plant health

| Crop | Env. | Dev. | Tissue | SEQ ID NOS: | Genus | Mean Abundance | log2 Fold Change | adjusted p-value | DeSeq Rank | Normalized Beta Co-efficients | GLM rank | Mean Decrease Gini | Random Forest Rank | Ensemble Rank |
|---|---|---|---|---|---|---|---|---|---|---|---|---|---|---|
| | | | | 248; 483; 484; 485; 486; 487; 488; 489; 490; 491; 492; 493; 494; 495; 496; 497; 498; 499; 500; 501; 502; 503; 504; 505; 506; 507; 508; 509; 510; 166 | Lentzea | 0.00248179 | 6.70515701 | 1.30E-10 | 4 | 0 | 10 | 0.48939766 | 4 | 1.001559682 |
| | | | | 261 | Lechevalieria | 0.00106311 | 5.7249503 | 6.71E-08 | 6 | 0 | 10 | 0.42565798 | 6 | 1.002339713 |
| | | | Root | 259 | Sphingomonas | 0.00019847 | 5.10877633 | 4.89E-08 | 7 | 0 | 15 | 0.13333333 | 15 | 1.004301343 |
| | | | | 289 | Terrimonas | 0.00028225 | 4.30093746 | 6.43E-06 | 21 | 0 | 15 | 0.11580952 | 29 | 1.009776509 |
| | | | | 260 | Sphingomonas | 0.0022795 | 2.91650475 | 5.81E-05 | 35 | 0 | 15 | 0.1288854 | 19 | 1.010558676 |
| Corn | Flood | r1 | Root | 256 | Sphingomonas | 0.00014867 | 2.8864088 | 6.00E-05 | 36 | 0 | 15 | 0.13030769 | 18 | 1.010558676 |
| | | | Leaf | 249 | Stenotrophomonas | 0.00113474 | 4.96233106 | 8.06E-07 | 12 | 0 | 10 | 0.44770742 | 5 | 1.003314752 |
| | | | | 275; 68 | Duganella | 0.00078142 | 5.30949281 | 1.16E-06 | 14 | 0 | 10 | 0.38738412 | 8 | 1.004289791 |
| | | | | 272; 91 | Streptomyces | 0.0016208 | 6.23082865 | 9.64E-08 | 8 | 0 | 10 | 0.2117172 | 16 | 1.004679807 |
| | | | | 258 | Sphingomonas | 0.00072992 | 5.05356034 | 5.31E-06 | 16 | 0 | 10 | 0.33419784 | 9 | 1.004874815 |
| | | | | 266 | Streptomyces | 0.00074159 | 5.14324948 | 2.37E-06 | 15 | 0 | 10 | 0.21942718 | 15 | 1.005849854 |
| | | | | 291 | Pseudomonas | 0.00100313 | 5.37681778 | 5.62E-07 | 10 | 0 | 10 | 0.16218094 | 22 | 1.006239869 |
| | | | | 267; 268; 269; 270; 271; 448; 449; 450; 537; 538; 539; 540; 541; 542; 543; 544; 545; 127 | | | | | | | | | | |
| Corn | Flood | r1 | Leaf | 255; 63 | Acinetobacter | 0.00220648 | 2.54586217 | 4.80E-05 | 22 | 0 | 10 | 0.24746217 | 11 | 1.006434877 |
| | ND | v2 | Whole Plant | 511; 512; 513; 514; 515; 516; 517; 518 | Bradyrhizobium | 5.45E-05 | 2.7960257 | 3.67E-07 | 28 | 0.09961597 | 5 | 0.4815718 | 9 | 1.004820383 |
| | Cold | | Root | 308 | Exophiala | 0.02051538 | 2.5084033 | 0.00065942 | 14 | 0.0786032 | 4 | 0.30364825 | 15 | 0.035830619 |
| | | | | 312 | Exophiala | 0.00077588 | 1.33749592 | 0.27433822 | 83 | 0.03271423 | 7 | 0.08439161 | 77 | 0.181324647 |
| | | | | 313 | Rhizophagus | 0.00104312 | 1.42313649 | 0.27236413 | 80 | 0.01048885 | 14 | 0.17555556 | 32 | 0.136807818 |
| | | | | 366 | Mortierella rishikesha | 0.00118814 | 3.66512626 | 0.00138375 | 19 | 0.02529381 | 9 | 0.16304458 | 36 | 0.069489685 |
| | | v4 | Whole Plant | 317; 318; 319; 320; 321; 322; 323; 324; 325; 326; 327; 328; 329; 330; 331; 575; 576; 577; 578; 579; 580; 581; 582; 583; 584; 585; 586; 587 | Macrophomina | 0.00108012 | 3.17206841 | 0.01196545 | 34 | 0.00689925 | 12 | 0.13630218 | 46 | 0.074675325 |
| Corn | Drought | r2 | Flower | 314; 573 | Sporidiobolus | 0.01027622 | 5.91414354 | 1.00E-21 | 1 | 0 | 12 | 0.46841078 | 1 | 1.001471641 |
| | | | Root | 570 | Glomus | 0.00146865 | 2.73376948 | 0.14323708 | 78 | 0.04837079 | 7 | 0.20829375 | 22 | 0.079083518 |
| | | | | 571 | Rhizophagus | 0.00048618 | 5.75487128 | 0.00043687 | 18 | 0.00091622 | 17 | 0.1864038 | 31 | 0.048780488 |
| | | | | 572 | Glomus | 0.00074405 | 1.85942478 | 0.35170825 | 136 | 0.06552958 | 6 | 0.0152381 | 250 | 0.289726534 |
| | | | | 574 | Plectosphaerella | 0.00195706 | 0.90349916 | 0.56973782 | 158 | 0.04123164 | 8 | 0.0193030 | 197 | 0.268292683 |
| | | | Stem | 314; 573 | Sporidiobolus | 0.01398359 | 9.62850282 | 1.86E-24 | 1 | 0.36576242 | 1 | 1.67810992 | 1 | 0.002214022 |
| | | | | 307 | Cyphellophora | 0.00205504 | 4.59111472 | 0.00098554 | 9 | 0.36527355 | 2 | 0.54962791 | 7 | 0.013284133 |

TABLE 11-continued

Microbial OTU that are positive predictors of plant health

| Crop | Env. | Dev. | Tissue | SEQ ID NOS: | Genus | Mean Abundance | log2 Fold Change | adjusted p-value | DeSeq Rank | Normalized Beta Co-efficients | GLM rank | Mean Decrease Gini | Random Forest Rank | Ensemble Rank |
|---|---|---|---|---|---|---|---|---|---|---|---|---|---|---|
| Corn | Drought | r2 | Stem | 334 | Fusarium | 0.00884883 | 10.6751408 | 4.71E-10 | 4 | 0.16967563 | 3 | 0.38720968 | 13 | 0.014760148 |
| | | | | 365 | Fusarium | 0.02349984 | 0.60093618 | 0.78352665 | 57 | 0.03303082 | 10 | 0.17346454 | 26 | 0.068634686 |
| | | | | 367 | Neosetophoma | 0.00068951 | 5.85420764 | 0.01446416 | 12 | 0.124962 | 4 | 0.21071865 | 22 | 0.0280428 |
| Corn | Flood | r1 | Leaf | 293; 294; 295; 296; 297; 298; 299; 300; 301; 302; 303; 304; 305; 569 | Fusarium | 0.00731263 | 8.88458949 | 1.40E-11 | 3 | 0.12825487 | 2 | 0.71555678 | 3 | 0.005904059 |
| Corn | Flood | r1 | Leaf | 335; 336; 337; 338; 339; 340; 341; 342; 343; 344; 345; 346; 347; 348; 349; 350; 351; 352; 353; 354; 355; 356; 357; 358; 359; 360; 361; 362; 363; 364; 392; 393; 394; 395; 396; 397; 398; 399; 400; 401; 402; 403; 404; 405; 406; 407; 408; 409; 410; 411; 412; 413; 414; 415; 416; 417; 418; 419; 420; 421; 422; 423; 424; 425; 426; 427; 428; 429; 430; 431; 432; 433; 434; 460; 461; 462; 589; 590; 591; 592; 593; 594; 595; 596; 597; 598; 599; 600; 601; 602; 603; 604; 605; 606; 607; 608; 609; 610; 611; 612; 613; 614; 615; 616; 617; 618; 619; 620; 621; 622; 623; 624; 625; 626; 627; 628; 629; 630 | Alternaria | 0.28778385 | 0.6764401 | 0.37888675 | 27 | 0.54098153 | 1 | 0.53891602 | 8 | 0.026568266 |
| Corn | Flood | r1 | Leaf | 309 | Puccinia | 0.0574981 | 10.1005082 | 9.41E-10 | 4 | 0.11019838 | 3 | 0.48186188 | 9 | 0.011808118 |
| | | | | 310 | Cochliobolus | 0.00056625 | 4.80488693 | 0.09498167 | 11 | 0.07981092 | 5 | 0.12854307 | 43 | 0.043542435 |
| | | | Root | 377 | Cochliobolus | 0.00034163 | 3.31001586 | 0.41033896 | 28 | 0.02158071 | 9 | 0.10495497 | 49 | 0.063468635 |
| | | | | 335; 336; 337; 338; 339; 340; 341; 342; 343; 344; 345; 346; 347; 348; 349; 350; 351; 352; 353; 354; 355; 356; 357; 358; 359; 360; 361; 362; | Alternaria | 0.10774632 | 2.88870171 | 4.84E-05 | 9 | 0.93487999 | 1 | 0.67712058 | 1 | 0.008130081 |

TABLE 11-continued

Microbial OTU that are positive predictors of plant health

| Crop | Env. | Dev. | Tissue | SEQ ID NOS: | Genus | Mean Abundance | log2 Fold Change | adjusted p-value | DeSeq Rank | Normalized Beta Co-efficients | GLM rank | Mean Decrease Gini | Random Forest Rank | Ensemble Rank |
|---|---|---|---|---|---|---|---|---|---|---|---|---|---|---|
| | | | | 363; 364; 392; 393; 394; 395; 396; 397; 398; 399; 400; 401; 402; 403; 404; 405; 406; 407; 408; 409; 410; 411; 412; 413; 414; 415; 416; 417; 418; 419; 420; 421; 422; 423; 424; 425; 426; 427; 428; 429; 430; 431; 432; 433; 434; 460; 461; 462; 589; 590; 591; 592; 593; 594; 595; 596; 597; 598; 599; 600; 601; 602; 603; 604; 605; 606; 607; 608; 609; 610; 611; 612; 613; 614; 615; 616; 617; 618; 619; 620; 621; 622; 623; 624; 625; 626; 627; 628; 629; 630 | | | | | | | | | |
| Corn | Flood | r1 | Root | 311 | Hannaella | 0.00010549 | 2.05847771 | 0.36663749 | 80 | 0.06523692 | 7 | 0.03295739 | 124 | 0.155949741 |
| | | | | 333 | Humicola | 0.00031409 | 5.00247378 | 0.00439531 | 19 | 0.0118156 | 13 | 0.09878331 | 49 | 0.059866962 |
| | | | | 378 | Fusarium | 0.0001494 | 3.97710254 | 0.00773929 | 28 | 0.2018055 | 2 | 0.1924289 | 21 | 0.037694013 |
| | | | Stem | 293; 294; 295; 296; 297; 298; 299; 300; 301; 302; 303; 304; 305; 569 | | 0.0219369 | 7.53269471 | 4.51E-07 | 9 | 0.26473101 | 2 | 0.46117673 | 11 | 0.016236162 |
| Corn | Flood | r1 | Stem | 332; 588 | Phoma | 0.01658263 | 2.67037459 | 0.02220081 | 19 | 0.18504399 | 3 | 0.99681273 | 1 | 0.01697417 |
| | | | | 335; 336; 337; 338; 339; 340; 341; 342; 343; 344; 345; 346; 347; 348; 349; 350; 351; 352; 353; 354; 355; 356; 357; 358; 359; 360; 361; 362; 363; 364; 392; 393; 394; 395; 396; 397; 398; 399; 400; 401; 402; 403; 404; 405; 406; 407; 408; 409; 410; 411; 412; 413; 414; 415; 416; 417; 418; 419; 420; 421; 422; 423; 424; 425; | Alternaria | 0.11790515 | 0.96106285 | 0.10609472 | 33 | 0.73489238 | 1 | 0.9413976 | 2 | 0.026568266 |

TABLE 11-continued

Microbial OTU that are positive predictors of plant health

| Crop | Env. | Dev. | Tissue | SEQ ID NOS: | Genus | Mean Abundance | log2 Fold Change | adjusted p-value | DeSeq Rank | Normalized Beta Co-efficients | GLM rank | Mean Decrease Gini | Random Forest Rank | Ensemble Rank |
|---|---|---|---|---|---|---|---|---|---|---|---|---|---|---|
| | | | | 426; 427; 428; 429; 430; 431; 432; 433; 434; 460; 461; 462; 589; 590; 591; 592; 593; 594; 595; 596; 597; 598; 599; 600; 601; 602; 603; 604; 605; 606; 607; 608; 609; 610; 611; 612; 613; 614; 615; 616; 617; 618; 619; 620; 621; 622; 623; 624; 625; 626; 627; 628; 629; 630 | | | | | | | | | |
| Corn | Flood | r1 | Stem | 306 | Gibberella | 0.05276147 | 3.65488051 | 0.00563992 | 17 | 0.15519278 | 4 | 0.52372391 | 7 | 0.020664207 |
| Soy | Cold | v5 | Stem | 315 | Leptosphaeria | 0.00126682 | 5.20386466 | 0.09328682 | 29 | 0.02352527 | 7 | 0.13199251 | 45 | 0.059778598 |
| | | | | 316 | Ophiosphaerella | 0.00314043 | 4.39341829 | 0.13405939 | 38 | 0.00492687 | 8 | 0.20966821 | 27 | 0.053874539 |
| | | | | 332; 588 | Phoma | 0.00300499 | 3.0619869 | 0.03334572 | 30 | 0.04009489 | 7 | 0.06453154 | 65 | 0.11027027 |
| | | | | 368; 369; 370; 371; 372; 373; 374; 375; 376; 463; 464; 465; 466; 467; 468; 469; 470; 471; 472; 473; 474; 631; 632; 633; 634; 635; 636 | Epicoccum | 0.02946166 | -1.2054828 | 0.22971232 | 55 | 0.02633238 | 10 | 0.21287791 | 19 | 0.090810811 |
| | | | | 637 | Acremonium | 0.01464632 | 5.25657387 | 0.02149724 | 23 | 0.10983412 | 3 | 0.14823971 | 33 | 0.063783784 |
| | | v1 | Whole Plant | 368; 369; 370; 371; 372; 373; 374; 375; 376; 463; 464; 465; 466; 467; 468; 469; 470; 471; 472; 473; 474; 631; 632; 633; 634; 635; 636 | Epicoccum | 0.00424572 | 2.43315019 | 0.00493558 | 22 | 0.09581268 | 6 | 0.37778037 | 21 | 0.039772727 |
| | ND | v2 | | 317; 318; 319; 320; 321; 322; 323; 324; 325; 326; 327; 328; 329; 330; 331; 575; 576; 577; 578; 579; 580; 581; 582; 583; 584; 585; 586; 587 | Macrophomina | 0.00076704 | 1.82419358 | 0.01957271 | 24 | 0 | 10 | 0.48998893 | 13 | 1.030025879 |
| Soy | ND | v2 | Whole Plant | 332; 588 | Phoma | 0.03566365 | 0.5640175 | 0.20723625 | 66 | 0.03413866 | 7 | 0.46256322 | 18 | 0.073863636 |

Example 7. Isolation and Identification of Endophytes

Isolation and cultivation of endophytic microbes from agricultural plants was performed using methods well known in the art. DNA was extracted from the ground tissues using the DNeasy DNA extraction kit (Qiagen, Hilden, Germany) according to the manufacturer's instructions. The endophytes were characterized by the sequences of genomic regions. Primers that amplify genomic regions of the endophytes of the present invention are listed in Table 12.

TABLE 12

Primer sequences useful in identifying microbes of the present invention

| Primers | Genomic locus |
|---|---|
| 27f (5'-AGAGTTTGATYMTGGCTCAG-3') (SEQ ID NO: 1) 1492r (5'-GGTTACCTTGTTACGACTT-3') (SEQ ID NO: 2) | 16S |
| 515f (5'-GTGCCAGCMGCCGCGGTAA-3') (SEQ ID NO: 3) 806r (5'-GGACTACHVGGGTWTCTAAT-3') (SEQ ID NO: 4) | 16S |
| ITS_1 (5'-CTTGGTCATTTAGAGGAAGTAA-3') (SEQ ID NO: 206) LR5 (5'-TCCTGAGGGAAACTTCG-3') (SEQ ID NO: 207) | ITS |
| ITS_2 (5'-GCTGCGTTCTTCATCGATGC-3') (SEQ ID NO: 208) ITS_3 (5'-GCATCGATGAAGAACGCAGC-3') (SEQ ID NO: 209) | ITS |
| fITS7: 5'-GTGARTCATCGAATCTTTG-3' (SEQ ID NO: 210) ITS4: 5'-TCCTCCGCTTATTGATATGC-3' (SEQ ID NO: 211) | ITS |
| PGK (5'-GTYGAYTTCAAYGTYCC-3') (SEQ ID NO: 212) PGK (5'-ACACCDGGDGGRCCGTTCCA-3') (SEQ ID NO: 213) | Phosphoglycerate kinase |
| ACT512f, Actin, primer - amplicon F (5'-ATGTGCAAGGCCGGTTTCG-3') (SEQ ID NO: 214) ACT783r, Actin, primer - amplicon R (5'-TACGAGTCCTTCTGGCCCAT-3') (SEQ ID NO: 215) | Actin |
| fusA-f2, elongation factor G, primer - amplicon F (5'-TCGCGTTCGTTAACAAAATGGACCGTAT-3') (SEQ ID NO: 216) fusA-R2, elongation factor G, primer - amplicon R (5'-TCGCCAGACGGCCCAGAGCCAGACCCAT-3') (SEQ ID NO: 217) | elongation factor G |
| RPB1-Af, largest subunit of RNA polymerase II, primer - amplicon F (5'-GARTGYCCDGGDCAYTTYGG-3') (SEQ ID NO: 218) RPB1-Cr, largest subunit of RNA polymerase II, primer - amplicon R (5'-CCNGCDATNTCRTTRTCCATRTA-3') (SEQ ID NO: 219) | largest subunit of RNA polymerase II |

TABLE 12-continued

Primer sequences useful in identifying microbes of the present invention

| Primers | Genomic locus |
|---|---|
| LR0R, long subunit rRNA gene, primer - amplicon F (5'-ACCCGCTGAACTTAAGC-3') (SEQ ID NO: 220) LR5, long subunit rRNA gene, primer - amplicon R (5'-TCCTGAGGGAAACTTCG-3') (SEQ ID NO: 207) | long subunit rRNA gene |
| bRPB2-7.1R, second largest subunit of RNA polymerase II, primer - amplicon R (5'-CCCATRGCYTGYTTMCCCATDGC-3') (SEQ ID NO: 221) fRPB2-5F, second largest subunit of RNA polymerase II, primer - amplicon F (5'-GAYGAYMGWGATCAYTTYGG-3') (SEQ ID NO: 222) | second largest subunit of RNA polymerase II |
| NS1 (5'-GTAGTCATATGCTTGTCTC-3') (SEQ ID NO: 223) NS4 (5'-CTTCCGTCAATTCCTTTAAG-3') (SEQ ID NO: 224) | SSU, small subunit rRNA gene |
| SR1R (5'-TACCTGGTTGATTCTGCCAGT-3') (SEQ ID NO: 225) NS4 (5'-CTTCCGTCAATTCCTTTAAG-3') (SEQ ID NO: 224) | SSU, small subunit rRNA gene |
| Btub2Fd, beta-tubulin, primer - amplicon F (5'-GTBCACCTYCARACCGGYCARTG-3') (SEQ ID NO: 226) Btub4Rd, beta-tubulin, primer - amplicon R (5'-CCRGAYTGRCCRAARACRAAGTTGTC-3') (SEQ ID NO: 227) | Beta-tubulin |

Example 8: Isolation and Identification of Bacterial and Fungal Endophytes

Classification of the Bacterial Strains Using its 16S Sequence was Done by the Following Methodology.

To accurately characterize isolated bacterial endophytes, colonies were submitted for marker gene sequencing, and the sequences were analyzed to provide taxonomic classifications. Colonies were subjected to 16S rRNA gene PCR amplification using a primer pair 27f (5'-AGAGTTT-GATYMTGGCTCAG-3') (SEQ ID NO: 1), where Y is C or T and M is A or C and 1492r (5'-GGTTACCTTGT-TACGACTT-3') (SEQ ID NO: 2). Sequencing reactions were performed using primers: 27f (5'-AGAGTTT-GATYMTGGCTCAG-3') (SEQ ID NO: 1), 515f (5'-GTGCCAGCMGCCGCGGTAA-3') (SEQ ID NO: 3), 806r (5'-GGACTACHVGGGTWTCTAAT-3') (SEQ ID NO: 4), and 1492r (5'-GGTTACCTTGTTACGACTT-3') (SEQ ID NO: 2), where Y is C or T, M is A or C, H is A or C or T, V is A or C or G, and W is A or T. Preferably sequencing primers are chosen so that overlapping regions are sequenced. Sanger sequencing of was performed at Genewiz (South Plainfield, NJ). Raw chromatograms were converted to sequences, and corresponding quality scores were assigned using TraceTuner v3.0.6beta (U.S. Pat. No. 6,681, 186). These sequences were quality filtered, aligned and a consensus sequence generated using Geneious v 8.1.8 (Biomatters Limited, Auckland NZ).

Taxonomic classifications were assigned to the sequences using the highest probability of assignment based on the results of industry standard taxonomic classification tools: LCA (runs USEARCH (Edgar, R. C., 2010) with option search_global, then for all best match hits, returns lowest taxonomic rank shared by all best hits for a query), RDP Naive Bayesian rRNA Classifier version 2.11, September 2015 (Wang et al., 2007), SPINGO version 1.3 (32 bit) (Allard et al. (2015) BMC Bioinformatics 16:324 DOI: 10.1186/s12859-015-0747-1), and UTAX version v8.1.1861_i861inux64 (Edgar, R. C. (2016) available online at drive5.com/usearch/manual/utax_algo.html), using reference databases: RDP 16S rRNA training set 15 (Cole et al., 2014), and SILVA version 119 (Quast et al., 2013). The classifier and database combinations listed in Table 13 were used to assign taxonomy to bacterial sequences.

TABLE 13

The classifier and database combinations used to classify 16S sequences

| Classifier | Database |
|---|---|
| LCA | SILVA, version 119 |
| RDP | RDP, 16S rRNA training set 15 |
| SPINGO | RDP, 16S rRNA training set 15 |
| UTAX | RDP, 16S rRNA training set 15 |
|  | SILVA, version 119 |

Classification of the Fungal Strain Using ITS Sequences was Done by the Following Methodology.

Total genomic DNA was extracted from individual fungal isolates, using the DNeasy Plant Mini Kit (Qiagen, Germantown, MD). Polymerase Chain Reaction (PCR) was used to amplify a genomic region including the nuclear ribosomal internal transcribed spacers (ITS) using a primer pair ITS_1 (5'-CTTGGTCATTTAGAGGAAGTAA-3') (SEQ ID NO: 206) and LR5 (5'-TCCTGAGGGAAACTTCG-3') (SEQ ID NO: 207). Each 25 microliter-reaction mixture included 22.5 microliters of Invitrogen Platinum Taq supermix, 0.5 microliter of each primer (10 uM), and 1.5 microliters of DNA template (~2-4 ng). Cycling reactions were run with MJ Research PTC thermocyclers and consisted of 94° C. for 5 min, 35 cycles of 94° C. for 30 s, 54° C. for 30 s, and 72° C. for 1 min, and 72° C. for 10 min. Sanger sequencing of was performed at Genewiz (South Plainfield, NJ) using primers: ITS_1 (5'-CTTGGTCATTTAGAGGAAGTAA-3') (SEQ ID NO: 206, ITS_2 (5'-GCTGCGTTCTTCATC-GATGC-3') (SEQ ID NO: 208), ITS_3 (5'-GCATCGAT-GAAGAACGCAGC-3') (SEQ ID NO: 209), and LR5 (5'-TCCTGAGGGAAACTTCG-3') (SEQ ID NO: 207). Sequencing primers were chosen so that overlapping regions were sequenced. Raw chromatograms were converted to sequences, and corresponding quality scores were assigned using TraceTuner v3.0.6beta (U.S. Pat. No. 6,681,186). These sequences were quality filtered, aligned and a consensus sequence generated using Geneious v 8.1.8 (Biomatters Limited, Auckland NZ).

Taxonomic classifications were assigned to the sequences using the highest probability of assignment based on the results of industry standard taxonomic classification tools: LCA (runs USEARCH (Edgar, R. C. (2010) Bioinformatics. 26(19):2460-2461) with option search_global, then for all best match hits, returns lowest taxonomic rank shared by all best hits for a query), SPINGO (Allard et al. (2015) BMC Bioinformatics. 16: 324), and UTAX (Edgar, R. C., 2016), using the WARCUP Fungal ITS trainset 1 (Deshpande et al. (2016) Mycologia 108(1):1-5) and UNITE (Koljalg et al. (2013) Molecular Ecology, 22: 5271-5277). The classifier and database combinations listed in Table 14 were used to assign taxonomy to fungal sequences.

TABLE 14

The classifier and database combinations used to classify ITS sequences

| Classifier | Database |
|---|---|
| LCA | UNITE, Fungal ITS trainset Jul. 4, 2014 |
| RDP | UNITE, Fungal ITS trainset Jul. 4, 2014 |
|  | WARCUP, Fungal ITS trainset 1 |
| SPINGO | UNITE, Fungal ITS trainset Jul. 4, 2014 |
| UTAX | UNITE, Fungal ITS trainset Jul. 4, 2014 |
|  | WARCUP, Fungal ITS trainset 1 |

TABLE 15

Taxonomic classification of exemplary endophytes predictive of the phenotype of plant health.

| SEQ ID NO: | MIC ID | Phylum | Class | Order | Family | Genus | Species |
|---|---|---|---|---|---|---|---|
| 228 | MIC-14854 | Proteobacteria | Gammaproteobacteria | Enterobacterales | Enterobacteriaceae | *Enterobacter* |  |
| 229 | MIC-56611 | Proteobacteria | Gammaproteobacteria | Enterobacteriales | Enterobacteriaceae | *Enterobacter* |  |
| 230 | MIC-98261 | Proteobacteria | Gammaproteobacteria | Enterobacteriales | Enterobacteriaceae | *Lelliottia* | *amnigena* |
| 231 |  | Proteobacteria | Gammaproteobacteria | Enterobacteriales | Enterobacteriaceae |  |  |
| 232 | MIC-15571 | Proteobacteria | Gammaproteobacteria | Pseudomonadales | Moraxellaceae | *Acinetobacter* | *calcoaceticus* |
| 233 | MIC-85839 | Proteobacteria | Gammaproteobacteria | Pseudomonadales | Moraxellaceae | *Acinetobacter* |  |
| 234 | MIC-94333 | Proteobacteria | Gammaproteobacteria | Pseudomonadales | Moraxellaceae | *Acinetobacter* |  |
| 235 |  | Proteobacteria | Gammaproteobacteria | Pseudomonadales | Moraxellaceae | *Acinetobacter* |  |
| 236 | MIC-27633 | Actinobacteria | Actinobacteria | Actinomycetales | Micrococcaceae | *Arthrobacter* | *pascens* |
| 237 | MIC-39282 | Actinobacteria | Actinobacteria | Actinomycetales | Micrococcaceae | *Arthrobacter* |  |
| 238 | MIC-55778 | Actinobacteria | Actinobacteria | Actinomycetales | Micrococcaceae | *Arthrobacter* |  |
| 239 | MIC-38342 | Actinobacteria | Actinobacteria | Actinomycetales | Micrococcaceae | *Arthrobacter* |  |
| 240 | MIC-90541 | Actinobacteria | Actinobacteria | Actinomycetales | Micrococcaceae | *Arthrobacter* |  |
| 241 | MIC-69857 | Actinobacteria | Actinobacteria | Actinomycetales | Micrococcaceae | *Arthrobacter* |  |
| 242 | MIC-60622 | Actinobacteria | Actinobacteria | Actinomycetales | Micrococcaceae | *Arthrobacter* |  |
| 243 | MIC-42527 | Actinobacteria | Actinobacteria | Actinomycetales | Micrococcaceae | *Arthrobacter* |  |
| 244 | MIC-57605 | Actinobacteria | Actinobacteria | Actinomycetales | Micrococcaceae | *Arthrobacter* |  |
| 245 | MIC-27745 | Actinobacteria | Actinobacteria | Actinomycetales | Micrococcaceae | *Arthrobacter* |  |
| 246 |  | Actinobacteria | Actinobacteria | Actinomycetales | Micrococcaceae | *Arthrobacter* |  |
| 247 |  | Actinobacteria | Actinobacteria | Actinomycetales | Micrococcaceae | *Arthrobacter* |  |

TABLE 15-continued

Taxonomic classification of exemplary endophytes predictive of the phenotype of plant health.

| SEQ ID NO: | MIC ID | Phylum | Class | Order | Family | Genus | Species |
|---|---|---|---|---|---|---|---|
| 248 | | Actinobacteria | Actinobacteria | Actinomycetales | Micrococcaceae | *Arthrobacter* | |
| 249 | | Proteobacteria | Alphaproteobacteria | Sphingomonadales | Sphingomonadaceae | *Sphingomonas* | |
| 250 | | Proteobacteria | Betaproteobacteria | Burkholderiales | Comamonadaceae | *Variovorax* | |
| 251 | | Firmicutes | Erysipelotrichia | Erysipelotrichales | Erysipelotrichaceae | *Asteroleplasma* | |
| 252 | | Proteobacteria | Gammaproteobacteria | Xanthomonadales | Xanthomonadaceae | *Stenotrophomonas* | |
| 253 | | Proteobacteria | Alphaproteobacteria | Rhizobiales | Bradyrhizobiaceae | *Bradyrhizobium* | |
| 254 | | Proteobacteria | Alphaproteobacteria | Rhizobiales | Bradyrhizobiaceae | *Bradyrhizobium* | |
| 255 | | Proteobacteria | Gammaproteobacteria | Pseudomonadales | Moraxellaceae | *Acinetobacter* | |
| 256 | | Proteobacteria | Alphaproteobacteria | Sphingomonadales | Sphingomonadaceae | *Sphingomonas* | |
| 257 | | Proteobacteria | Gammaproteobacteria | Pseudomonadales | Pseudomonadaceae | *Pseudomonas* | |
| 258 | | Actinobacteria | Actinobacteria | Actinomycetales | Streptomycetaceae | *Streptomyces* | |
| 259 | | Actinobacteria | Actinobacteria | Actinomycetales | Pseudonocardiaceae | *Lechevalieria* | |
| 260 | | Bacteroidetes | Chitinophagia | Chitinophagales | Chitinophagaceae | *Terrimonas* | |
| 261 | | Actinobacteria | Actinobacteria | Actinomycetales | Pseudonocardiaceae | *Lentzea* | |
| 262 | | Proteobacteria | Betaproteobacteria | Burkholderiales | Burkholderiaceae | *Ralstonia* | |
| 263 | | Proteobacteria | Betaproteobacteria | Burkholderiales | Burkholderiaceae | *Ralstonia* | |
| 264 | | Proteobacteria | Gammaproteobacteria | Xanthomonadales | Xanthomonadaceae | *Stenotrophomonas* | |
| 265 | | Proteobacteria | Deltaproteobacteria | Myxococcales | Cystobacteraceae | *Anaeromyxobacter* | |
| 266 | | Proteobacteria | Alphaproteobacteria | Sphingomonadales | Sphingomonadaceae | *Sphingomonas* | |
| 267 | MIC-25666 | Proteobacteria | Gammaproteobacteria | Pseudomonadales | Pseudomonadaceae | *Pseudomonas* | |
| 268 | MIC-87610 | Proteobacteria | Gammaproteobacteria | Pseudomonadales | Pseudomonadaceae | *Pseudomonas* | |
| 269 | MIC-23289 | Proteobacteria | Gammaproteobacteria | Pseudomonadales | Pseudomonadaceae | *Pseudomonas* | |
| 270 | | Proteobacteria | Gammaproteobacteria | Pseudomonadales | Pseudomonadaceae | *Pseudomonas* | |
| 271 | | Proteobacteria | Gammaproteobacteria | Pseudomonadales | Pseudomonadaceae | *Pseudomonas* | |
| 272 | | Proteobacteria | Betaproteobacteria | Burkholderiales | Oxalobacteraceae | *Duganella* | |
| 273 | | Proteobacteria | Alphaproteobacteria | Rhizobiales | Rhizobiaceae | *Rhizobium* | |
| 274 | | Proteobacteria | Betaproteobacteria | Burkholderiales | Burkholderiaceae | *Ralstonia* | |
| 275 | | Proteobacteria | Gammaproteobacteria | Xanthomonadales | Xanthomonadaceae | *Stenotrophomonas* | |
| 276 | | Proteobacteria | Alphaproteobacteria | Sphingomonadales | Sphingomonadaceae | *Sphingomonas* | |
| 277 | | Proteobacteria | Alphaproteobacteria | Rhizobiales | Aurantimonadaceae | *Aureimonas* | |
| 278 | | Proteobacteria | Alphaproteobacteria | Rhodospirillales | Rhodospirillaceae | *Azospirillum* | |
| 279 | MIC-13997 | Proteobacteria | Gammaproteobacteria | Enterobacteriales | Enterobacteriaceae | *Pantoea* | |
| 280 | MIC-51965 | Proteobacteria | Gammaproteobacteria | Enterobacteriales | Enterobacteriaceae | *Pantoea* | |
| 281 | | Proteobacteria | Gammaproteobacteria | Enterobacteriales | Enterobacteriaceae | *Pantoea* | |
| 282 | | Proteobacteria | Gammaproteobacteria | Pseudomonadales | Pseudomonadaceae | *Pseudomonas* | |
| 283 | MIC-16769 | Proteobacteria | Alphaproteobacteria | Sphingomonadales | Sphingomonadaceae | *Sphingomonas* | |
| 284 | MIC-88267 | Proteobacteria | Alphaproteobacteria | Sphingomonadales | Sphingomonadaceae | *Sphingomonas* | |
| 285 | MIC-13743 | Proteobacteria | Alphaproteobacteria | Sphingomonadales | Sphingomonadaceae | *Sphingomonas* | |
| 286 | MIC-38702 | Proteobacteria | Alphaproteobacteria | Sphingomonadales | Sphingomonadaceae | *Sphingomonas* | |
| 287 | MIC-44274 | Proteobacteria | Alphaproteobacteria | Sphingomonadales | Sphingomonadaceae | *Sphingomonas* | |
| 288 | | Proteobacteria | Alphaproteobacteria | Sphingomonadales | Sphingomonadaceae | *Sphingomonas* | |
| 289 | | Proteobacteria | Alphaproteobacteria | Sphingomonadales | Sphingomonadaceae | *Sphingomonas* | |
| 290 | | Proteobacteria | Gammaproteobacteria | Xanthomonadales | Xanthomonadaceae | *Stenotrophomonas* | |
| 291 | | Actinobacteria | Actinobacteria | Actinomycetales | Streptomycetaceae | *Streptomyces* | |
| 292 | | Firmicutes | Erysipelotrichia | Erysipelotrichales | Erysipelotrichaceae | *Asteroleplasma* | |
| 293 | MIC-99102 | Ascomycota | Sordariomycetes | Hypocreales | Nectriaceae | *Fusarium* | *redolens* |
| 294 | MIC-85209 | Ascomycota | Sordariomycetes | Hypocreales | Nectriaceae | *Fusarium* | *redolens* |
| 295 | MIC-42417 | Ascomycota | Sordariomycetes | Hypocreales | Nectriaceae | *Fusarium* | *redolens* |
| 296 | MIC-91061 | Ascomycota | Sordariomycetes | Hypocreales | Nectriaceae | *Fusarium* | *redolens* |
| 297 | MIC-97049 | Ascomycota | Sordariomycetes | Hypocreales | Nectriaceae | *Fusarium* | *redolens* |
| 298 | MIC-63462 | Ascomycota | Sordariomycetes | Hypocreales | Nectriaceae | *Fusarium* | *redolens* |
| 299 | MIC-86413 | Ascomycota | Sordariomycetes | Hypocreales | Nectriaceae | *Fusarium* | *redolens* |
| 300 | MIC-71246 | Ascomycota | Sordariomycetes | Hypocreales | Nectriaceae | *Fusarium* | *redolens* |
| 301 | MIC-91253 | Ascomycota | Sordariomycetes | Hypocreales | Nectriaceae | *Fusarium* | *redolens* |
| 302 | MIC-90877 | Ascomycota | Sordariomycetes | Hypocreales | Nectriaceae | *Fusarium* | *redolens* |
| 303 | | Ascomycota | Sordariomycetes | Hypocreales | Nectriaceae | *Fusarium* | |
| 304 | | Ascomycota | Sordariomycetes | Hypocreales | Nectriaceae | *Fusarium* | |
| 305 | MIC-85125 | Ascomycota | Sordariomycetes | Hypocreales | Nectriaceae | *Fusarum* | *redolens* |
| 306 | | Ascomycota | Sordariomycetes | Hypocreales | Nectriaceae | *Gibberella* | |
| 307 | | Ascomycota | Eurotiomycetes | Chaetothyriales | Chaetothyriaceae | *Cyphellophora* | |
| 308 | | Ascomycota | Eurotiomycetes | Chaetothyriales | Herpotrichiellaceae | *Exophiala* | |
| 309 | | Basidiomycota | Pucciniomycetes | Pucciniales | Pucciniaceae | *Puccinia* | |
| 310 | | Ascomycota | Dothideomycetes | Pleosporales | Pleosporaceae | *Cochliobolus* | |
| 311 | | Basidiomycota | Tremellomycetes | Tremellales | Incertae_sedis_12 | *Hannaella* | |
| 312 | | Ascomycota | Eurotiomycetes | Chaetothyriales | Herpotrichiellaceae | *Exophiala* | |
| 313 | | Glomeromycota | Glomeromycetes | Glomerates | Glomeraceae | *Rhizophagus* | |
| 314 | | Basidiomycota | Microbotryomycetes | Sporidiobotales | Sporidiobolaceae | *Sporidiobolus* | |
| 315 | | Ascomycota | Dothideomycetes | Pleosporales | Leptosphaeriaceae | *Leptosphaeria* | |
| 316 | | Ascomycota | Dothideomycetes | Pleosporales | Phaeosphaeriaceae | *Ophiosphaerella* | |
| 317 | MIC-38663 | Ascomycota | Dothideomycetes | Botryosphaeriales | Botryosphaeriaceae | *Macrophomina* | *phaseolina* |
| 318 | MIC-37432 | Ascomycota | Dothideomycetes | Botryosphaeriales | Botryosphaeriaceae | *Macrophomina* | *phaseolina* |
| 319 | MIC-45992 | Ascomycota | Dothideomycetes | Botryosphaeriales | Botryosphaeriaceae | *Macrophomina* | *phaseolina* |
| 320 | MIC-30170 | Ascomycota | Dothideomycetes | Botryosphaeriales | Botryosphaeriaceae | *Macrophomina* | *phaseolina* |
| 321 | MIC-28733 | Ascomycota | Dothideomycetes | Botryosphaeriales | Botryosphaeriaceae | *Macrophomina* | *phaseolina* |

TABLE 15-continued

Taxonomic classification of exemplary endophytes predictive of the phenotype of plant health.

| SEQ ID NO: | MIC ID | Phylum | Class | Order | Family | Genus | Species |
|---|---|---|---|---|---|---|---|
| 322 | MIC-25833 | Ascomycota | Dothideomycetes | Botryosphaeriales | Botryosphaeriaceae | *Macrophomina* | *phaseolina* |
| 323 | MIC-22861 | Ascomycota | Dothideomycetes | Botryosphaeriales | Botryosphaeriaceae | *Macrophomina* | *phaseolina* |
| 324 | MIC-14391 | Ascomycota | Dothideomycetes | Botryosphaeriales | Botryosphaeriaceae | *Macrophomina* | *phaseolina* |
| 325 | MIC-53155 | Ascomycota | Dothideomycetes | Botryosphaeriales | Botryosphaeriaceae | *Macrophomina* | *phaseolina* |
| 326 | MIC-78976 | Ascomycota | Dothideomycetes | Botryosphaeriales | Botryosphaeriaceae | *Macrophomina* | *phaseolina* |
| 327 | MIC-95848 | Ascomycota | Dothideomycetes | Botryosphaeriales | Botryosphaeriaceae | *Macrophomina* | *phaseolina* |
| 328 | MIC-96651 | Ascomycota | Dothideomycetes | Botryosphaeriales | Botryosphaeriaceae | *Macrophomina* | *phaseolina* |
| 329 | MIC-66989 | Ascomycota | Dothideomycetes | Botryosphaeriales | Botryosphaeriaceae | *Macrophomina* | *phaseolina* |
| 330 | MIC-32306 | Ascomycota | Dothideomycetes | Botryosphaeriales | Botryosphaeriaceae | *Macrophomina* | *phaseolina* |
| 331 | MIC-96182 | Ascomycota | Dothideomycetes | Botryosphaeriales | Botryosphaeriaceae | *Macrophomina* | *phaseolina* |
| 332 | | Ascomycota | Dothideomycetes | Pleosporales | Incertae_sedis_13 | *Phoma* | |
| 333 | | Basidiomycota | Tremellomycetes | Tremellales | Tremellaceae | *Cryptococcus* | |
| 334 | | Ascomycota | Sordariomycetes | Hypocreales | Nectriaceae | *Fusarium* | |
| 335 | MIC-60123 | Ascomycota | Dothideomycetes | Pleosporales | Pleosporaceae | *Alternaria* | *eichhorniae* |
| 336 | MIC-60562 | Ascomycota | Dothideomycetes | Pleosporales | Pleosporaceae | *Alternaria* | *eichhorniae* |
| 337 | MIC-88545 | Ascomycota | Dothideomycetes | Pleosporales | Pleosporaceae | *Alternaria* | *eichhorniae* |
| 338 | MIC-50852 | Ascomycota | Dothideomycetes | Pleosporales | Pleosporaceae | *Alternaria* | *eichhorniae* |
| 339 | MIC-50669 | Ascomycota | Dothideomycetes | Pleosporales | Pleosporaceae | *Alternaria* | *eichhorniae* |
| 340 | MIC-70767 | Ascomycota | Dothideomycetes | Pleosporales | Pleosporaceae | *Alternaria* | *eichhorniae* |
| 341 | MIC-30176 | Ascomycota | Dothideomycetes | Pleosporales | Pleosporaceae | *Alternaria* | *eichhorniae* |
| 342 | MIC-24328 | Ascomycota | Dothideomycetes | Pleosporales | Pleosporaceae | *Alternaria* | *eichhorniae* |
| 343 | MIC-85655 | Ascomycota | Dothideomycetes | Pleosporales | Pleosporaceae | *Alternaria* | *eichhorniae* |
| 344 | MIC-16991 | Ascomycota | Dothideomycetes | Pleosporales | Pleosporaceae | *Alternaria* | *eichhorniae* |
| 345 | MIC-74159 | Ascomycota | Dothideomycetes | Pleosporales | Pleosporaceae | *Alternaria* | *eichhorniae* |
| 346 | MIC-60109 | Ascomycota | Dothideomycetes | Pleosporales | Pleosporaceae | *Alternaria* | *eichhorniae* |
| 347 | MIC-32356 | Ascomycota | Dothideomycetes | Pleosporales | Pleosporaceae | *Alternaria* | *eichhorniae* |
| 348 | MIC-84068 | Ascomycota | Dothideomycetes | Pleosporales | Pleosporaceae | *Alternaria* | *eichhorniae* |
| 349 | MIC-40227 | Ascomycota | Dothideomycetes | Pleosporales | Pleosporaceae | *Alternaria* | *eichhorniae* |
| 350 | MIC-47598 | Ascomycota | Dothideomycetes | Pleosporales | Pleosporaceae | *Alternaria* | *eichhorniae* |
| 351 | MIC-34201 | Ascomycota | Dothideomycetes | Pleosporales | Pleosporaceae | *Alternaria* | *eichhorniae* |
| 352 | MIC-85136 | Ascomycota | Dothideomycetes | Pleosporales | Pleosporaceae | *Alternaria* | *eichhorniae* |
| 353 | MIC-77190 | Ascomycota | Dothideomycetes | Pleosporales | Pleosporaceae | *Alternaria* | *eichhorniae* |
| 354 | MIC-88731 | Ascomycota | Dothideomycetes | Pleosporales | Pleosporaceae | *Alternaria* | *eichhorniae* |
| 355 | MIC-98898 | Ascomycota | Dothideomycetes | Pleosporales | Pleosporaceae | *Alternaria* | *eichhorniae* |
| 356 | MIC-52896 | Ascomycota | Dothideomycetes | Pleosporales | Pleosporaceae | *Alternaria* | *eichhorniae* |
| 357 | MIC-20951 | Ascomycota | Dothideomycetes | Pleosporales | Pleosporaceae | *Alternaria* | *eichhorniae* |
| 358 | MIC-38351 | Ascomycota | Dothideomycetes | Pleosporales | Pleosporaceae | *Alternaria* | *eichhorniae* |
| 359 | MIC-61445 | Ascomycota | Dothideomycetes | Pleosporales | Pleosporaceae | *Alternaria* | *eichhorniae* |
| 360 | MIC-54736 | Ascomycota | Dothideomycetes | Pleosporales | Pleosporaceae | *Alternaria* | *eichhorniae* |
| 361 | MIC-65133 | Ascomycota | Dothideomycetes | Pleosporales | Pleosporaceae | *Alternaria* | |
| 362 | MIC-31426 | Ascomycota | Dothideomycetes | Pleosporales | Pleosporaceae | *Alternaria* | |
| 363 | | Ascomycota | Dothideomycetes | Pleosporales | Pleosporaceae | *Alternaria* | |
| 364 | | Ascomycota | Dothideomycetes | Pleosporales | Pleosporaceae | *Alternaria* | |
| 365 | | Ascomycota | Sordariomycetes | Hypocreales | Nectriaceae | *Fusarium* | |
| 366 | | Mucoromycota | Mortierellales | Mortierellaceae | Mortierella | *Mortierella* | |
| 367 | | Ascomycota | Dothideomycetes | Pleosporales | Leptosphaeriaceae | *Neosetophoma* | |
| 368 | MIC-58584 | Ascomycota | Dothideomycetes | Pleosporales | Pleosporaceae | *Epicoccum* | *sorghi* |
| 369 | MIC-44939 | Ascomycota | Dothideomycetes | Pleosporales | Pleosporaceae | *Epicoccum* | *sorghi* |
| 370 | MIC-22486 | Ascomycota | Dothideomycetes | Pleosporales | Pleosporaceae | *Epicoccum* | *sorghi* |
| 371 | MIC-65674 | Ascomycota | Dothideomycetes | Pleosporales | Pleosporaceae | *Epicoccum* | *sorghi* |
| 372 | MIC-76501 | Ascomycota | Dothideomycetes | Pleosporales | Pleosporaceae | *Epicoccum* | *sorghi* |
| 373 | MIC-72926 | Ascomycota | Dothideomycetes | Pleosporales | Pleosporaceae | *Epicoccum* | *sorghi* |
| 374 | MIC-99435 | Ascomycota | Dothideomycetes | Pleosporales | Pleosporaceae | *Epicoccum* | *sorghi* |
| 375 | MIC-42948 | Ascomycota | Dothideomycetes | Pleosporales | Pleosporaceae | *Epicoccum* | *sorghi* |
| 376 | MIC-63007 | Ascomycota | Dothideomycetes | Pleosporales | Pleosporaceae | *Epicoccum* | *sorghi* |
| 377 | | Ascomycota | Dothideomycetes | Pleosporales | Pleosporaceae | *Cochliobolus* | |
| 378 | | Ascomycota | Sordariomycetes | Sordariales | Chaetomiaceae | *Humicola* | |
| 379 | MIC-58100 | Proteobacteria | Gammaproteobacteria | Enterobacterales | Enterobacteriaceae | *Enterobacter* | *cloacae* |
| 380 | MIC-92436 | Proteobacteria | Gammaproteobacteria | Enterobacterales | Enterobacteriaceae | *Enterobacter* | |
| 381 | MIC-13094 | Proteobacteria | Gammaproteobacteria | Enterobacterales | Enterobacteriaceae | *Enterobacter* | |
| 382 | MIC-94201 | Proteobacteria | Gammaproteobacteria | Enterobacterales | Erwiniaceae | *Erwinia* | *aphidicola* |
| 383 | MIC-42597 | Proteobacteria | Gammaproteobacteria | Enterobacterales | Erwiniaceae | *Erwinia* | |
| 384 | MIC-25045 | Proteobacteria | Gammaproteobacteria | Enterobacterales | Enviniaceae | *Erwinia* | |
| 385 | MIC-94112 | Proteobacteria | Gammaproteobacteria | Enterobacterales | Enviniaceae | *Erwinia* | |
| 386 | MIC-91800 | Proteobacteria | Gammaproteobacteria | Enterobacterales | Enviniaceae | *Erwinia* | |
| 387 | MIC-15256 | Proteobacteria | Betaproteobacteria | Burkholderiales | Burkholderiaceae | *Ralstonia* | *pickettii* |
| 388 | MIC-25671 | Proteobacteria | Betaproteobacteria | Burkholderiales | Burkholderiaceae | *Ralstonia* | |
| 389 | MIC-15256 | Proteobacteria | Betaproteobacteria | Burkholderiales | Burkholderiaceae | *Ralstonia* | *pickettii* |
| 390 | MIC-25671 | Proteobacteria | Betaproteobacteria | Burkholderiales | Burkholderiaceae | *Ralstonia* | |
| 391 | MIC-55255 | Proteobacteria | Gammaproteobacteria | Enterobacterales | Enterobacteriaceae | *Pantoea* | |
| 392 | MIC-95879 | Ascomycota | Dothideomycetes | Pleosporales | Pleosporaceae | *Alternaria* | *eichhorniae* |
| 393 | MIC-18644 | Ascomycota | Dothideomycetes | Pleosporales | Pleosporaceae | *Alternaria* | *eichhorniae* |
| 394 | MIC-55463 | Ascomycota | Dothideomycetes | Pleosporales | Pleosporaceae | *Alternaria* | *eichhorniae* |
| 395 | MIC-23334 | Ascomycota | Dothideomycetes | Pleosporales | Pleosporaceae | *Alternaria* | *eichhorniae* |

TABLE 15-continued

Taxonomic classification of exemplary endophytes predictive of the phenotype of plant health.

| SEQ ID NO: | MIC ID | Phylum | Class | Order | Family | Genus | Species |
|---|---|---|---|---|---|---|---|
| 396 | MIC-68265 | Ascomycota | Dothideomycetes | Pleosporales | Pleosporaceae | Alternaria | eichhorniae |
| 397 | MIC-17760 | Ascomycota | Dothideomycetes | Pleosporales | Pleosporaceae | Alternaria | eichhorniae |
| 398 | MIC-66389 | Ascomycota | Dothideomycetes | Pleosporales | Pleosporaceae | Alternaria | eichhorniae |
| 399 | MIC-70787 | Ascomycota | Dothideomycetes | Pleosporales | Pleosporaceae | Alternaria | eichhorniae |
| 400 | MIC-25346 | Ascomycota | Dothideomycetes | Pleosporales | Pleosporaceae | Alternaria | eichhorniae |
| 401 | MIC-99168 | Ascomycota | Dothideomycetes | Pleosporales | Pleosporaceae | Alternaria | eichhorniae |
| 402 | MIC-39779 | Ascomycota | Dothideomycetes | Pleosporales | Pleosporaceae | Alternaria | eichhorniae |
| 403 | MIC-19127 | Ascomycota | Dothideomycetes | Pleosporales | Pleosporaceae | Alternaria | eichhorniae |
| 404 | MIC-64876 | Ascomycota | Dothideomycetes | Pleosporales | Pleosporaceae | Alternaria | eichhorniae |
| 405 | MIC-44343 | Ascomycota | Dothideomycetes | Pleosporales | Pleosporaceae | Alternaria | eichhorniae |
| 406 | MIC-72477 | Ascomycota | Dothideomycetes | Pleosporales | Pleosporaceae | Alternaria | eichhorniae |
| 407 | MIC-26966 | Ascomycota | Dothideomycetes | Pleosporales | Pleosporaceae | Alternaria | eichhorniae |
| 408 | MIC-95064 | Ascomycota | Dothideomycetes | Pleosporales | Pleosporaceae | Alternaria | eichhorniae |
| 409 | MIC-70933 | Ascomycota | Dothideomycetes | Pleosporales | Pleosporaceae | Alternaria | eichhorniae |
| 410 | MIC-30500 | Ascomycota | Dothideomycetes | Pleosporales | Pleosporaceae | Alternaria | eichhorniae |
| 411 | MIC-24706 | Ascomycota | Dothideomycetes | Pleosporales | Pleosporaceae | Alternaria | eichhorniae |
| 412 | MIC-34208 | Ascomycota | Dothideomycetes | Pleosporales | Pleosporaceae | Alternaria | eichhorniae |
| 413 | MIC-96685 | Ascomycota | Dothideomycetes | Pleosporales | Pleosporaceae | Alternaria | eichhorniae |
| 414 | MIC-43461 | Ascomycota | Dothideomycetes | Pleosporales | Pleosporaceae | Alternaria | eichhorniae |
| 415 | MIC-97685 | Ascomycota | Dothideomycetes | Pleosporales | Pleosporaceae | Alternaria | eichhorniae |
| 416 | MIC-68802 | Ascomycota | Dothideomycetes | Pleosporales | Pleosporaceae | Alternaria | eichhorniae |
| 417 | MIC-51331 | Ascomycota | Dothideomycetes | Pleosporales | Pleosporaceae | Alternaria | eichhorniae |
| 418 | MIC-77965 | Ascomycota | Dothideomycetes | Pleosporales | Pleosporaceae | Alternaria | eichhorniae |
| 419 | MIC-36968 | Ascomycota | Dothideomycetes | Pleosporales | Pleosporaceae | Alternaria | eichhorniae |
| 420 | MIC-83208 | Ascomycota | Dothideomycetes | Pleosporales | Pleosporaceae | Alternaria | eichhorniae |
| 421 | MIC-65804 | Ascomycota | Dothideomycetes | Pleosporales | Pleosporaceae | Alternaria | eichhorniae |
| 422 | MIC-70922 | Ascomycota | Dothideomycetes | Pleosporales | Pleosporaceae | Alternaria | eichhorniae |
| 423 | MIC-16241 | Ascomycota | Dothideomycetes | Pleosporales | Pleosporaceae | Alternaria | eichhorniae |
| 424 | MIC-10648 | Ascomycota | Dothideomycetes | Pleosporales | Pleosporaceae | Alternaria | eichhorniae |
| 425 | MIC-30417 | Ascomycota | Dothideomycetes | Pleosporales | Pleosporaceae | Alternaria | eichhorniae |
| 426 | MIC-61728 | Ascomycota | Dothideomycetes | Pleosporales | Pleosporaceae | Alternaria | eichhorniae |
| 427 | MIC-15209 | Ascomycota | Dothideomycetes | Pleosporales | Pleosporaceae | Alternaria | eichhorniae |
| 428 | MIC-78843 | Ascomycota | Dothideomycetes | Pleosporales | Pleosporaceae | Alternaria | eichhorniae |
| 429 | MIC-21659 | Ascomycota | Dothideomycetes | Pleosporales | Pleosporaceae | Alternaria | eichhorniae |
| 430 | MIC-51022 | Ascomycota | Dothideomycetes | Pleosporales | Pleosporaceae | Alternaria | eichhorniae |
| 431 | MIC-72751 | Ascomycota | Dothideomycetes | Pleosporales | Pleosporaceae | Alternaria | eichhorniae |
| 432 | MIC-78824 | Ascomycota | Dothideomycetes | Pleosporales | Pleosporaceae | Alternaria | eichhorniae |
| 433 | MIC-11576 | Ascomycota | Dothideomycetes | Pleosporales | Pleosporaceae | Alternaria | eichhorniae |
| 434 | MIC-47951 | Ascomycota | Gammaproteobacteria | Pleosporales | Pleosporaceae | Alternaria | eichhorniae |
| 435 | MIC-96957 | Proteobacteria | Gammaproteobacteria | Enterobacterales | Enterobacteriaceae | Enterobacter | cloacae |
| 436 | MIC-32670 | Proteobacteria | Gammaproteobacteria | Enterobacterales | Enterobacteriaceae | Enterobacter | cloacae |
| 437 | MIC-15014 | Proteobacteria | Gammaproteobacteria | Enterobacterales | Enterobacteriaceae | Enterobacter | cloacae |
| 438 | MIC-74133 | Proteobacteria | Gammaproteobacteria | Enterobacterales | Enterobacteriaceae | Enterobacter | cloacae |
| 439 | MIC-58005 | Proteobacteria | Gammaproteobacteria | Enterobacteriales | Enterobacteriaceae | Enterobacter | |
| 440 | MIC-41411 | Proteobacteria | Gammaproteobacteria | Enterobacteriales | Enterobacteriaceae | Enterobacter | |
| 441 | MIC-88425 | Proteobacteria | Gammaproteobacteria | Enterobacteriales | Enterobacteriaceae | Enterobacter | |
| 442 | MIC-78003 | Proteobacteria | Gammaproteobacteria | Enterobacteriales | Enterobacteriaceae | Enterobacter | |
| 443 | MIC-77772 | Proteobacteria | Gammaproteobacteria | Enterobacteriales | Enterobacteriaceae | Pantoea | |
| 444 | MIC-40517 | Proteobacteria | Gammaproteobacteria | Xanthomonadales | Xanthomonadaceae | Stenotrophomonas | |
| 445 | MIC-82011 | Proteobacteria | Gammaproteobacteria | Xanthomonadales | Xanthomonadaceae | Stenotrophomonas | |
| 446 | MIC-50753 | Proteobacteria | Gammaproteobacteria | Xanthomonadales | Xanthomonadaceae | Stenotrophomonas | |
| 447 | MIC-22775 | Proteobacteria | Gammaproteobacteria | Xanthomonadales | Xanthomonadaceae | Stenotrophomonas | |
| 448 | MIC-48004 | Proteobacteria | Gammaproteobacteria | Pseudomonadales | Pseudomonadaceae | Pseudomonas | fluorescens |
| 449 | MIC-30715 | Proteobacteria | Gammaproteobacteria | Pseudomonadales | Pseudomonadaceae | Pseudomonas | fluorescens |
| 450 | MIC-79944 | Proteobacteria | Gammaproteobacteria | Pseudomonadales | Pseudomonadaceae | Pseudomonas | |
| 451 | MIC-20465 | Proteobacteria | Gammaproteobacteria | Enterobacteriales | Enterobacteriaceae | Pantoea | ananatis |
| 452 | MIC-85005 | Proteobacteria | Gammaproteobacteria | Enterobacteriales | Enterobacteriaceae | Pantoea | dispersa |
| 453 | MIC-80616 | Proteobacteria | Gammaproteobacteria | Enterobacteriales | Enterobacteriaceae | Pantoea | dispersa |
| 454 | MIC-14159 | Proteobacteria | Gammaproteobacteria | Enterobacteriales | Enterobacteriaceae | Pantoea | |
| 455 | MIC-35191 | Proteobacteria | Gammaproteobacteria | Enterobacteriales | Enterobacteriaceae | Pantoea | |
| 456 | MIC-84661 | Proteobacteria | Gammaproteobacteria | Enterobacteriales | Enterobacteriaceae | Pantoea | |
| 457 | MIC-59354 | Proteobacteria | Alphaproteobacteria | Sphingomonadales | Sphingomonadaceae | Sphingomonas | sanguinis |
| 458 | MIC-87930 | Proteobacteria | Alphaproteobacteria | Sphingomonadales | Sphingomonadaceae | Sphingomonas | trueperi |
| 459 | MIC-40715 | Proteobacteria | Alphaproteobacteria | Sphingomonadales | Sphingomonadaceae | Sphingomonas | yabuuchiae |
| 460 | MIC-96734 | Ascomycota | Dothideomycetes | Pleosporales | Pleosporaceae | Alternaria | eichhorniae |
| 461 | MIC-34536 | Ascomycota | Dothideomycetes | Pleosporales | Pleosporaceae | Alternaria | eichhorniae |
| 462 | MIC-62546 | Ascomycota | Dothideomycetes | Pleosporales | Pleosporaceae | Alternaria | eichhorniae |
| 463 | MIC-18241 | Ascomycota | Dothideomycetes | Pleosporales | Pleosporaceae | Epicoccum | sorghi |
| 464 | MIC-81584 | Ascomycota | Dothideomycetes | Pleosporales | Pleosporaceae | Epicoccum | sorghi |
| 465 | MIC-40887 | Ascomycota | Dothideomycetes | Pleosporales | Pleosporaceae | Epicoccum | sorghi |
| 466 | MIC-96469 | Ascomycota | Dothideomycetes | Pleosporales | Pleosporaceae | Epicoccum | sorghi |
| 467 | MIC-33075 | Ascomycota | Dothideomycetes | Pleosporales | Pleosporaceae | Epicoccum | sorghi |
| 468 | MIC-11317 | Ascomycota | Dothideomycetes | Pleosporales | Pleosporaceae | Epicoccum | sorghi |
| 469 | MIC-96261 | Ascomycota | Dothideomycetes | Pleosporales | Pleosporaceae | Epicoccum | sorghi |

TABLE 15-continued

Taxonomic classification of exemplary endophytes predictive of the phenotype of plant health.

| SEQ ID NO: | MIC ID | Phylum | Class | Order | Family | Genus | Species |
|---|---|---|---|---|---|---|---|
| 470 | MIC-67259 | Ascomycota | Dothideomycetes | Pleosporales | Pleosporaceae | *Epicoccum* | *sorghi* |
| 471 | MIC-96545 | Ascomycota | Dothideomycetes | Pleosporales | Pleosporaceae | *Epicoccum* | *sorghi* |
| 472 | MIC-92943 | Ascomycota | Dothideomycetes | Pleosporales | Pleosporaceae | *Epicoccum* | *sorghi* |
| 473 | MIC-24360 | Ascomycota | Dothideomycetes | Pleosporales | Pleosporaceae | *Epicoccum* | *sorghi* |
| 474 | MIC-87403 | Ascomycota | Dothideomycetes | Pleosporales | Pleosporaceae | *Epicoccum* | *sorghi* |
| 475 | MIC-29144 | Proteobacteria | Gammaproteobacteria | Enterobacterales | Enterobacteriaceae | *Enterobacter* | |
| 476 | MIC-72189 | Proteobacteria | Gammaproteobacteria | Enterobacterales | Enterobacteriaceae | *Enterobacter* | |
| 477 | MIC-87606 | Proteobacteria | Gammaproteobacteria | Enterobacterales | Enterobacteriaceae | *Enterobacter* | |
| 478 | MIC-71974 | Proteobacteria | Gammaproteobacteria | Enterobacterales | Erwiniaceae | *Erwinia* | *persicina* |
| 479 | MIC-50800 | Proteobacteria | Gammaproteobacteria | Enterobacterales | | | |
| 480 | MIC-49657 | Proteobacteria | Gammaproteobacteria | Enterobacteriales | Enterobacteriaceae | *Erwinia* | |
| 481 | MIC-13457 | Proteobacteria | Gammaproteobacteria | Enterobacteriales | Enterobacteriaceae | | |
| 482 | MIC-91735 | Proteobacteria | Gammaproteobacteria | Pseudomonadales | Moraxellaceae | *Acinetobacter* | *calcoaceticus* |
| 483 | MIC-19383 | Actinobacteria | Actinobacteria | Actinomycetales | Micrococcaceae | *Arthrobacter* | *globiformis* |
| 484 | MIC-98945 | Actinobacteria | Actinobacteria | Actinomycetales | Micrococcaceae | *Arthrobacter* | *humicola* |
| 485 | MIC-85213 | Actinobacteria | Actinobacteria | Actinomycetales | Micrococcaceae | *Arthrobacter* | *onzae* |
| 486 | MIC-86315 | Actinobacteria | Actinobacteria | Actinomycetales | Micrococcaceae | *Arthrobacter* | *onzae* |
| 487 | MIC-33876 | Actinobacteria | Actinobacteria | Actinomycetales | Micrococcaceae | *Arthrobacter* | *onzae* |
| 488 | MIC-12566 | Actinobacteria | Actinobacteria | Actinomycetales | Micrococcaceae | *Arthrobacter* | *phenanthrenivorans* |
| 489 | MIC-24556 | Actinobacteria | Actinobacteria | Actinomycetales | Micrococcaceae | *Arthrobacter* | |
| 490 | MIC-27853 | Actinobacteria | Actinobacteria | Actinomycetales | Micrococcaceae | *Arthrobacter* | |
| 491 | MIC-27618 | Actinobacteria | Actinobacteria | Actinomycetales | Micrococcaceae | *Arthrobacter* | |
| 492 | MIC-32908 | Actinobacteria | Actinobacteria | Actinomycetales | Micrococcaceae | *Arthrobacter* | |
| 493 | MIC-59043 | Actinobacteria | Actinobacteria | Actinomycetales | Micrococcaceae | *Arthrobacter* | |
| 494 | MIC-69988 | Actinobacteria | Actinobacteria | Actinomycetales | Micrococcaceae | *Arthrobacter* | |
| 495 | MIC-92363 | Actinobacteria | Actinobacteria | Actinomycetales | Micrococcaceae | *Arthrobacter* | |
| 496 | MIC-16624 | Actinobacteria | Actinobacteria | Actinomycetales | Micrococcaceae | *Arthrobacter* | |
| 497 | MIC-54549 | Actinobacteria | Actinobacteria | Actinomycetales | Micrococcaceae | *Arthrobacter* | |
| 498 | MIC-44916 | Actinobacteria | Actinobacteria | Actinomycetales | Micrococcaceae | *Arthrobacter* | |
| 499 | MIC-56375 | Actinobacteria | Actinobacteria | Actinomycetales | Micrococcaceae | *Arthrobacter* | |
| 500 | MIC-36280 | Actinobacteria | Actinobacteria | Actinomycetales | Micrococcaceae | *Arthrobacter* | |
| 501 | MIC-25563 | Actinobacteria | Actinobacteria | Actinomycetales | Micrococcaceae | *Arthrobacter* | |
| 502 | MIC-47865 | Actinobacteria | Actinobacteria | Actinomycetales | Micrococcaceae | *Arthrobacter* | |
| 503 | MIC-52315 | Actinobacteria | Actinobacteria | Actinomycetales | Micrococcaceae | *Arthrobacter* | |
| 504 | MIC-15752 | Actinobacteria | Actinobacteria | Actinomycetales | Micrococcaceae | *Arthrobacter* | |
| 505 | MIC-36591 | Actinobacteria | Actinobacteria | Actinomycetales | Micrococcaceae | *Arthrobacter* | |
| 506 | MIC-54938 | Actinobacteria | Actinobacteria | Actinomycetales | Micrococcaceae | *Arthrobacter* | |
| 507 | MIC-80524 | Actinobacteria | Actinobacteria | Actinomycetales | Micrococcaceae | *Arthrobacter* | |
| 508 | MIC-39994 | Actinobacteria | Actinobacteria | Actinomycetales | Micrococcaceae | *Arthrobacter* | |
| 509 | MIC-16272 | Actinobacteria | Actinobacteria | Actinomycetales | Micrococcaceae | *Arthrobacter* | |
| 510 | MIC-17172 | Actinobacteria | Actinobacteria | Actinomycetales | Micrococcaceae | *Arthrobacter* | |
| 511 | MIC-14877 | Proteobacteria | Alphaproteobacteria | Rhizobiales | Bradyrhizobiaceae | *Bradyrhizobium* | |
| 512 | MIC-51915 | Proteobacteria | Alphaproteobacteria | Rhizobiales | Bradyrhizobiaceae | *Bradyrhizobium* | |
| 513 | MIC-96574 | Proteobacteria | Alphaproteobacteria | Rhizobiales | Bradyrhizobiaceae | *Bradyrhizobium* | |
| 514 | MIC-10832 | Proteobacteria | Alphaproteobacteria | Rhizobiales | Bradyrhizobiaceae | *Bradyrhizobium* | |
| 515 | MIC-47537 | Proteobacteria | Alphaproteobacteria | Rhizobiales | Bradyrhizobiaceae | *Bradyrhizobium* | |
| 516 | MIC-99383 | Proteobacteria | Alphaproteobacteria | Rhizobiales | Bradyrhizobiaceae | *Bradyrhizobium* | |
| 517 | MIC-42045 | Proteobacteria | Alphaproteobacteria | Rhizobiales | Bradyrhizobiaceae | *Bradyrhizobium* | |
| 518 | MIC-22302 | Proteobacteria | Alphaproteobacteria | Rhizobiales | Bradyrhizobiaceae | *Bradyrhizobium* | |
| 519 | MIC-14877 | Proteobacteria | Alphaproteobacteria | Rhizobiales | Bradyrhizobiaceae | *Bradyrhizobium* | |
| 520 | MIC-51915 | Proteobacteria | Alphaproteobacteria | Rhizobiales | Bradyrhizobiaceae | *Bradyrhizobium* | |
| 521 | MIC-90927 | Proteobacteria | Alphaproteobacteria | Rhizobiales | Bradyrhizobiaceae | *Bradyrhizobium* | |
| 522 | MIC-96574 | Proteobacteria | Alphaproteobacteria | Rhizobiales | Bradyrhizobiaceae | *Bradyrhizobium* | |
| 523 | MIC-10832 | Proteobacteria | Alphaproteobacteria | Rhizobiales | Bradyrhizobiaceae | *Bradyrhizobium* | |
| 524 | MIC-47537 | Proteobacteria | Alphaproteobacteria | Rhizobiales | Bradyrhizobiaceae | *Bradyrhizobium* | |
| 525 | MIC-99383 | Proteobacteria | Alphaproteobacteria | Rhizobiales | Bradyrhizobiaceae | *Bradyrhizobium* | |
| 526 | MIC-42045 | Proteobacteria | Alphaproteobacteria | Rhizobiales | Bradyrhizobiaceae | *Bradyrhizobium* | |
| 527 | MIC-22302 | Proteobacteria | Alphaproteobacteria | Rhizobiales | Bradyrhizobiaceae | *Bradyrhizobium* | |
| 528 | | Proteobacteria | Alphaproteobacteria | Rhizobiales | Bradyrhizobiaceae | *Bradyrhizobium* | |
| 529 | | Proteobacteria | Alphaproteobacteria | Rhizobiales | Bradyrhizobiaceae | *Bradyrhizobium* | |
| 530 | MIC-17708 | Proteobacteria | Betaproteobacteria | Burkholderiales | Burkholderiaceae | *Ralstonia* | *pickettii* |
| 531 | MIC-51402 | Proteobacteria | Betaproteobacteria | Burkholderiales | Burkholderiaceae | *Ralstonia* | |
| 532 | MIC-97988 | Proteobacteria | Betaproteobacteria | Burkholderiales | Burkholderiaceae | *Ralstonia* | |
| 533 | MIC-57302 | Proteobacteria | Betaproteobacteria | Burkholderiales | Burkholderiaceae | *Ralstonia* | |
| 534 | | Proteobacteria | Betaproteobacteria | Burkholderiales | Burkholderiaceae | *Ralstonia* | |
| 535 | MIC-63920 | Proteobacteria | Gammaproteobacteria | Xanthomonadales | Xanthomonadaceae | *Stenotrophomonas* | |
| 536 | | Proteobacteria | Gammaproteobacteria | Xanthomonadales | Xanthomonadaceae | *Stenotrophomonas* | |
| 537 | MIC-13902 | Proteobacteria | Gammaproteobacteria | Pseudomonadales | Pseudomonadaceae | *Pseudomonas* | *fluorescens* |
| 538 | MIC-62882 | Proteobacteria | Gammaproteobacteria | Pseudomonadales | Pseudomonadaceae | *Pseudomonas* | *frederiksbergensis* |
| 539 | MIC-81612 | Proteobacteria | Gammaproteobacteria | Pseudomonadales | Pseudomonadaceae | *Pseudomonas* | |
| 540 | MIC-50368 | Proteobacteria | Gammaproteobacteria | Pseudomonadales | Pseudomonadaceae | *Pseudomonas* | |
| 541 | MIC-35601 | Proteobacteria | Gammaproteobacteria | Pseudomonadales | Pseudomonadaceae | *Pseudomonas* | |
| 542 | MIC-57819 | Proteobacteria | Gammaproteobacteria | Pseudomonadales | Pseudomonadaceae | *Pseudomonas* | |
| 543 | MIC-90630 | Proteobacteria | Gammaproteobacteria | Pseudomonadales | Pseudomonadaceae | *Pseudomonas* | |

TABLE 15-continued

Taxonomic classification of exemplary endophytes predictive of the phenotype of plant health.

| SEQ ID NO: | MIC ID | Phylum | Class | Order | Family | Genus | Species |
|---|---|---|---|---|---|---|---|
| 544 | MIC-25601 | Proteobacteria | Gammaproteobacteria | Pseudomonadales | Pseudomonadaceae | *Pseudomonas* | |
| 545 | MIC-32940 | Proteobacteria | Gammaproteobacteria | Pseudomonadales | Pseudomonadaceae | *Pseudomonas* | |
| 546 | | Proteobacteria | Alphaproteobacteria | Rhizobiales | Bradyrhizobiaceae | *Bradyrhizobium* | |
| 547 | | Proteobacteria | Betaproteobacteria | Burkholderiales | Comamonadaceae | *Variovorax* | |
| 548 | MIC-17708 | Proteobacteria | Betaproteobacteria | Burkholderiales | Burkholderiaceae | *Ralstonia* | *pickettii* |
| 549 | MIC-51402 | Proteobacteria | Betaproteobacteria | Burkholderiales | Burkholderiaceae | *Ralstonia* | |
| 550 | MIC-97988 | Proteobacteria | Betaproteobacteria | Burkholderiales | Burkholderiaceae | *Ralstonia* | |
| 551 | MIC-57302 | Proteobacteria | Betaproteobacteria | Burkholderiales | Burkholderiaceae | *Ralstonia* | |
| 552 | | Proteobacteria | Betaproteobacteria | Burkholderiales | Burkholderiaceae | *Ralstonia* | |
| 553 | | Proteobacteria | Alphaproteobacteria | Sphingomonadales | Sphingomonadaceae | *Sphingobium* | |
| 554 | MIC-12159 | Proteobacteria | Gammaproteobacteria | Enterobacteriales | Enterobacteriaceae | *Pantoea* | *agglomerans* |
| 555 | MIC-83483 | Proteobacteria | Gammaproteobacteria | Enterobacteriales | Enterobacteriaceae | *Pantoea* | *ananatis* |
| 556 | MIC-21359 | Proteobacteria | Gammaproteobacteria | Enterobacteriales | Enterobacteriaceae | *Pantoea* | *ananatis* |
| 557 | MIC-78620 | Proteobacteria | Gammaproteobacteria | Enterobacteriales | Enterobacteriaceae | *Pantoea* | *ananatis* |
| 558 | MIC-44921 | Proteobacteria | Gammaproteobacteria | Enterobacteriales | Enterobacteriaceae | *Pantoea* | *ananatis* |
| 559 | MIC-46896 | Proteobacteria | Gammaproteobacteria | Enterobacteriales | Enterobacteriaceae | *Pantoea* | *ananatis* |
| 560 | MIC-89015 | Proteobacteria | Gammaproteobacteria | Enterobacteriales | Enterobacteriaceae | *Pantoea* | |
| 561 | MIC-60718 | Proteobacteria | Gammaproteobacteria | Enterobacteriales | Enterobacteriaceae | *Pantoea* | |
| 562 | MIC-21223 | Proteobacteria | Gammaproteobacteria | Enterobacteriales | Enterobacteriaceae | *Pantoea* | |
| 563 | MIC-84043 | Proteobacteria | Gammaproteobacteria | Enterobacteriales | Enterobacteriaceae | *Pantoea* | |
| 564 | MIC-57767 | Proteobacteria | Alphaproteobacteria | Sphingomonadales | Sphingomonadaceae | *Sphingomonas* | *azotifigens* |
| 565 | MIC-13610 | Proteobacteria | Alphaproteobacteria | Sphingomonadales | Sphingomonadaceae | *Sphingomonas* | |
| 566 | MIC-22785 | Proteobacteria | Alphaproteobacteria | Sphingomonadales | Sphingomonadaceae | *Sphingomonas* | *trueperi* |
| 567 | MIC-15964 | Proteobacteria | Alphaproteobacteria | Sphingomonadales | Sphingomonadaceae | *Sphingomonas* | |
| 568 | MIC-94900 | Proteobacteria | Alphaproteobacteria | Sphingomonadales | Sphingomonadaceae | *Sphingomonas* | |
| 569 | MIC-37228 | Ascomycota | Sordariomycetes | Hypocreales | Nectriaceae | *Fusarium* | *redolens* |
| 570 | | Glomeromycota | Glomeromycetes | Glomerales | Glomeraceae | *Glomus* | |
| 571 | | Glomeromycota | Glomeromycetes | Glomerales | Glomeraceae | *Rhizophagus* | |
| 572 | | Glomeromycota | Glomeromycetes | Glomerales | Glomeraceae | *Glomus* | |
| 573 | | Basidiomycota | Microbotryomycetes | Sporidiobotales | Sporidiobolaceae | *Sporidiobolus* | |
| 574 | | Ascomycota | Sordariomycetes | Hypocreomycetidae_Incertae sedis | Plectosphaerellaceae | *Plectosphaerella* | |
| 575 | MIC-94816 | Ascomycota | Dothideomycetes | Botryosphaeriales | Botryosphaeriaceae | *Macrophomina* | |
| 576 | MIC-41722 | Ascomycota | Dothideomycetes | Botryosphaeriales | Botryosphaeriaceae | *Macrophomina* | *phaseolina* |
| 577 | MIC-43258 | Ascomycota | Dothideomycetes | Botryosphaeriales | Botryosphaeriaceae | *Macrophomina* | *phaseolina* |
| 578 | MIC-13956 | Ascomycota | Dothideomycetes | Botryosphaeriales | Botryosphaeriaceae | *Macrophomina* | *phaseolina* |
| 579 | MIC-28924 | Ascomycota | Dothideomycetes | Botryosphaeriales | Botryosphaeriaceae | *Macrophomina* | *phaseolina* |
| 580 | MIC-97971 | Ascomycota | Dothideomycetes | Botryosphaeriales | Botryosphaeriaceae | *Macrophomina* | *phaseolina* |
| 581 | MIC-75686 | Ascomycota | Dothideomycetes | Botryosphaeriales | Botryosphaeriaceae | *Macrophomina* | *phaseolina* |
| 582 | MIC-87984 | Ascomycota | Dothideomycetes | Botryosphaeriales | Botryosphaeriaceae | *Macrophomina* | *phaseolina* |
| 583 | MIC-47360 | Ascomycota | Dothideomycetes | Botryosphaeriales | Botryosphaeriaceae | *Macrophomina* | *phaseolina* |
| 584 | MIC-41303 | Ascomycota | Dothideomycetes | Botryosphaeriales | Botryosphaeriaceae | *Macrophomina* | *phaseolina* |
| 585 | MIC-76657 | Ascomycota | Dothideomycetes | Botryosphaeriales | Botryosphaeriaceae | *Macrophomina* | *phaseolina* |
| 586 | MIC-21204 | Ascomycota | Dothideomycetes | Botryosphaeriales | Botryosphaeriaceae | *Macrophomina* | *phaseolina* |
| 587 | MIC-22213 | Ascomycota | Dothideomycetes | Botryosphaeriales | Botryosphaeriaceae | *Macrophomina* | *phaseolina* |
| 588 | | Ascomycota | Dothideomycetes | Pleosporales | Incertae_sedis_13 | *Phoma* | |
| 589 | MIC-11237 | Ascomycota | Dothideomycetes | Pleosporales | Pleosporaceae | *Alternaria* | *eichhorniae* |
| 590 | MIC-33001 | Ascomycota | Dothideomycetes | Pleosporales | Pleosporaceae | *Alternaria* | *eichhorniae* |
| 591 | MIC-84348 | Ascomycota | Dothideomycetes | Pleosporales | Pleosporaceae | *Alternaria* | *eichhorniae* |
| 592 | MIC-42954 | Ascomycota | Dothideomycetes | Pleosporales | Pleosporaceae | *Alternaria* | *eichhorniae* |
| 593 | MIC-25930 | Ascomycota | Dothideomycetes | Pleosporales | Pleosporaceae | *Alternaria* | *eichhorniae* |
| 594 | MIC-81644 | Ascomycota | Dothideomycetes | Pleosporales | Pleosporaceae | *Alternaria* | *eichhorniae* |
| 595 | MIC-58410 | Ascomycota | Dothideomycetes | Pleosporales | Pleosporaceae | *Alternaria* | *eichhorniae* |
| 596 | MIC-14328 | Ascomycota | Dothideomycetes | Pleosporales | Pleosporaceae | *Alternaria* | *eichhorniae* |
| 597 | MIC-97081 | Ascomycota | Dothideomycetes | Pleosporales | Pleosporaceae | *Alternaria* | *eichhorniae* |
| 598 | MIC-94592 | Ascomycota | Dothideomycetes | Pleosporales | Pleosporaceae | *Alternaria* | *eichhorniae* |
| 599 | MIC-49434 | Ascomycota | Dothideomycetes | Pleosporales | Pleosporaceae | *Alternaria* | *eichhorniae* |
| 600 | MIC-22762 | Ascomycota | Dothideomycetes | Pleosporales | Pleosporaceae | *Alternaria* | *eichhorniae* |
| 601 | MIC-25378 | Ascomycota | Dothideomycetes | Pleosporales | Pleosporaceae | *Alternaria* | *eichhorniae* |
| 602 | MIC-32433 | Ascomycota | Dothideomycetes | Pleosporales | Pleosporaceae | *Alternaria* | *eichhorniae* |
| 603 | MIC-27601 | Ascomycota | Dothideomycetes | Pleosporales | Pleosporaceae | *Alternaria* | *eichhorniae* |
| 604 | MIC-72097 | Ascomycota | Dothideomycetes | Pleosporales | Pleosporaceae | *Alternaria* | *eichhorniae* |
| 605 | MIC-93679 | Ascomycota | Dothideomycetes | Pleosporales | Pleosporaceae | *Alternaria* | *eichhorniae* |
| 606 | MIC-85003 | Ascomycota | Dothideomycetes | Pleosporales | Pleosporaceae | *Alternaria* | *eichhorniae* |
| 607 | MIC-70056 | Ascomycota | Dothideomycetes | Pleosporales | Pleosporaceae | *Alternaria* | *eichhorniae* |
| 608 | MIC-28234 | Ascomycota | Dothideomycetes | Pleosporales | Pleosporaceae | *Alternaria* | *eichhorniae* |
| 609 | MIC-58717 | Ascomycota | Dothideomycetes | Pleosporales | Pleosporaceae | *Alternaria* | *eichhorniae* |
| 610 | MIC-48121 | Ascomycota | Dothideomycetes | Pleosporales | Pleosporaceae | *Alternaria* | *eichhorniae* |
| 611 | MIC-48623 | Ascomycota | Dothideomycetes | Pleosporales | Pleosporaceae | *Alternaria* | *eichhorniae* |
| 612 | MIC-33559 | Ascomycota | Dothideomycetes | Pleosporales | Pleosporaceae | *Alternaria* | *eichhorniae* |
| 613 | MIC-29878 | Ascomycota | Dothideomycetes | Pleosporales | Pleosporaceae | *Alternaria* | *eichhorniae* |
| 614 | MIC-11430 | Ascomycota | Dothideomycetes | Pleosporales | Pleosporaceae | *Alternaria* | *eichhorniae* |
| 615 | MIC-84680 | Ascomycota | Dothideomycetes | Pleosporales | Pleosporaceae | *Alternaria* | *eichhorniae* |
| 616 | MIC-44372 | Ascomycota | Dothideomycetes | Pleosporales | Pleosporaceae | *Alternaria* | *eichhorniae* |

TABLE 15-continued

Taxonomic classification of exemplary endophytes predictive of the phenotype of plant health.

| SEQ ID NO: | MIC ID | Phylum | Class | Order | Family | Genus | Species |
|---|---|---|---|---|---|---|---|
| 617 | MIC-17827 | Ascomycota | Dothideomycetes | Pleosporales | Pleosporaceae | *Alternaria* | *eichhorniae* |
| 618 | MIC-28240 | Ascomycota | Dothideomycetes | Pleosporales | Pleosporaceae | *Alternaria* | *eichhorniae* |
| 619 | MIC-22383 | Ascomycota | Dothideomycetes | Pleosporales | Pleosporaceae | *Alternaria* | *eichhorniae* |
| 620 | MIC-64674 | Ascomycota | Dothideomycetes | Pleosporales | Pleosporaceae | *Alternaria* | *eichhorniae* |
| 621 | MIC-48609 | Ascomycota | Dothideomycetes | Pleosporales | Pleosporaceae | *Alternaria* | *eichhorniae* |
| 622 | MIC-14866 | Ascomycota | Dothideomycetes | Pleosporales | Pleosporaceae | *Alternaria* | *eichhorniae* |
| 623 | MIC-60881 | Ascomycota | Dothideomycetes | Pleosporales | Pleosporaceae | *Alternaria* | *eichhorniae* |
| 624 | MIC-15327 | Ascomycota | Dothideomycetes | Pleosporales | Pleosporaceae | *Alternaria* | *eichhorniae* |
| 625 | MIC-69898 | Ascomycota | Dothideomycetes | Pleosporales | Pleosporaceae | *Alternaria* | *eichhorniae* |
| 626 | MIC-73099 | Ascomycota | Dothideomycetes | Pleosporales | Pleosporaceae | *Alternaria* | *eichhorniae* |
| 627 | MIC-79626 | Ascomycota | Dothideomycetes | Pleosporales | Pleosporaceae | *Alternaria* | *eichhorniae* |
| 628 | MIC-36073 | Ascomycota | Dothideomycetes | Pleosporales | Pleosporaceae | *Alternaria* | *eichhorniae* |
| 629 | MIC-27459 | Ascomycota | Dothideomycetes | Pleosporales | Pleosporaceae | *Alternaria* | |
| 630 | MIC-79080 | Ascomycota | Dothideomycetes | Pleosporales | Pleosporaceae | *Alternaria* | |
| 631 | MIC-61189 | Ascomycota | Dothideomycetes | Pleosporales | Pleosporaceae | *Epicoccum* | *sorghi* |
| 632 | MIC-86673 | Ascomycota | Dothideomycetes | Pleosporales | Pleosporaceae | *Epicoccum* | *sorghi* |
| 633 | MIC-90249 | Ascomycota | Dothideomycetes | Pleosporales | Pleosporaceae | *Epicoccum* | *sorghi* |
| 634 | MIC-10453 | Ascomycota | Dothideomycetes | Pleosporales | Pleosporaceae | *Epicoccum* | *sorghi* |
| 635 | MIC-19655 | Ascomycota | Dothideomycetes | Pleosporales | Pleosporaceae | *Epicoccum* | *sorghi* |
| 636 | | Ascomycota | Dothideomycetes | Pleosporales | Pleosporaceae | *Epicoccum* | |
| 637 | | Ascomycota | Sordariomycetes | Glomerellales | Plectosphaerellaceae | *Acremonium* | |

Example 9: Assessment of Improved Plant Characteristics: Vigor Assay Assay of Soy Seedling Vigor Seed Preparation:

The lot quality of soybean seeds is first assessed by testing germination of 100 seeds. Seeds were placed, 8 seeds per petri dish, on filter paper in petri dishes, 12 mL of water was added to each plate and plates are incubated for 3 days at 24° C. The process should be repeated with a fresh seed lot if fewer than 95% of the seeds have germinated. One thousand soybean seeds are then surface sterilized by co-incubation with chlorine gas in a 20×30 cm container placed in a chemical fume hood for 16 hours. Percent germination of 50 seeds, per sterilization batch, is tested as above and confirmed to be greater than 95%.

Preparation of endophyte treatments: Spore solutions are made by rinsing and scraping spores from agar slants which have been growing for about 1 month. Rinsing is done with 0.05% Silwet. Solutions are passed through Miracloth to filter out mycelia. Spores per ml are counted under a microscope using a hemocytometer. The stock suspension is then diluted into 10^6 spores/ml utilizing water. 3 µl of spore suspension is used per soy seed (~10^3 CFUs/seed is obtained). Control treatments are prepared by adding equivalent volumes of sterile water to seeds.

Assay of seedling vigor: Two rolled pieces of germination paper are placed in a sterile glass gar with 50 mL sterile water, then removed when completely saturated. Then the papers are separated and inoculated seeds are placed at approximately 1 cm intervals along the length of one sheet of moistened germination paper, at least 2.5 cm from the top of the paper and 3.8 cm from the edge of the paper. The second sheet of is placed on top of the soy seeds and the layered papers and seeds are loosely rolled into a tube. Each tube is secured with a rubber band around the middle and placed in a single sterile glass jar and covered loosely with a lid. For each treatment, three jars with 15 seeds per jar are prepared. The position of jars within the growth chamber is randomized. Jars are incubated at 60% relative humidity, and 22° C. day, 18° C. night with 12 hours light and 12 hours dark for 4 days and then the lids are removed and the jars incubated for an additional 7 days. Then the germinated soy seedlings are weighed and photographed and root length and root surface area are scored as follows.

Dirt, excess water, seed coats and other debris is removed from seedlings to allow accurate scanning of the roots. Individual seedlings are laid out on clear plastic trays and trays are arranged on an Epson Expression 11000XL scanner (Epson America, Inc., Long Beach CA). Roots are manually arranged to reduce the amount of overlap. For root measurements, shoots are removed if the shape of the shoot causes it to overlap the roots.

The WinRHIZO software version *Arabidopsis* Pro2016a (Regents Instruments, Quebec Canada) is used with the following acquisition settings: greyscale 4000 dpi image, speed priority, overlapping (1 object), Root Morphology: Precision (standard), Crossing Detection (normal). The scanning area is set to the maximum scanner area. When the scan is completed, the root area is selected and root length and root surface area are measured.

Statistical analysis is performed using R (R Core Team, 2016. R: A language and environment for statistical computing. R Foundation for Statistical Computing, Vienna, Austria. R-project.org/) or a similar statistical software program.

Assay of Corn Seedling Vigor

Seed Preparation:

The lot quality of corn seeds is first evaluated for germination by transfer of 100 seeds and with 3.5 mL of water to a filter paper lined petri dish. Seeds are incubated for 3 days at 24° C. The process should be repeated with a fresh seed lot if fewer than 95% of the seeds have germinated. One thousand corn seeds are then surface sterilized by co-incubation with chlorine gas in a 20×30 cm container in a chemical fume hood for 12 hours. Percent germination of 50 seeds, per sterilization batch, is tested as above and confirmed to be greater than 95%.

Optional Reagent Preparation:

7.5% PEG 6000 (Calbiochem, San Diego, CA) is prepared by adding 75 g of PEG to 1000 mL of water, then stirred on a warm hot plate until the PEG is fully dissolved. The solution is then autoclaved.

Preparation of Endophyte Treatments:

Spore solutions are made by rinsing and scraping spores from agar slants which have been growing for about 1 month. Rinsing is done with 0.05% Silwet. Solutions are passed through Miracloth to filter out mycelia. Spores per ml are counted under a microscope using a hemocytometer. The stock suspension is then diluted into 10^6 spores/ml utilizing water. 3 µl of spore suspension is used per corn seed (~10^3 CFUs/seed is obtained). Control treatments are prepared by adding equivalent volumes of sterile water to seeds.

Assay of Seedling Vigor:

Either 25 ml of sterile water or, optionally, 25 ml of PEG solution as prepared above, is added to each Cyg™ germination pouch (Mega International, Newport, MN) and place into pouch rack (Mega International, Newport, MN). Sterile forceps are used to place corn seeds prepared as above into every other perforation in the germination pouch. Seeds are fitted snugly into each perforation to ensure they did not shift when moving the pouches. Before and in between treatments forceps are sterilized using ethanol and flame and workspace wiped down with 70% ethanol. For each treatment, three pouches with 15 seeds per pouch are prepared. The germination racks with germination pouches are placed into plastic tubs, and covered with perforated plastic wrap to prevent drying. Tubs are incubated at 60% relative humidity, and 22° C. day, 18° C. night with 12 hours light and 12 hours dark for 6 days to allow for germination and root length growth. Placement of pouches within racks and racks/tubs within the growth chamber is randomized to minimize positional effect. At the end of 6 days the corn seeds are scored manually for germination, root and shoot length.

Statistical analysis is performed using R or a similar statistical software program.

Assay of Wheat Seedling Vigor

Seed Preparation:

The lot of wheat seeds is first evaluated for germination by transfer of 100 seeds and with 8 mL of water to a filter paper lined petri dish. Seeds are incubated for 3 days at 24° C. The process should be repeated with a fresh seed lot if fewer than 95% of the seeds have germinated. Wheat seeds are then surface sterilized by co-incubation with chlorine gas in a 20×30 cm container in a chemical fume hood for 12 hours. Percent germination of 50 seeds, per sterilization batch, is tested as above and confirmed to be greater than 95%.

Optional Reagent Preparation:

7.5% polyethylene glycol (PEG) is prepared by adding 75 g of PEG to 1000 mL of water, then stirring on a warm hot plate until the PEG is fully dissolved. The solution is then autoclaved.

Preparation of Endophyte Treatments:

Spore solutions are made by rinsing and scraping spores from agar slants which have been growing for about 1 month. Rinsing was done with 0.05% Silwet. Solutions are passed through Miracloth to filter out mycelia. Spores per ml are counted under a microscope using a hemocytometer. The stock suspension is then diluted into 10^6 spores/ml utilizing water. 3 µl of spore suspension is used per wheat seed (~10^3 CFUs/seed was obtained). Seeds and spores are combined a 50 mL falcon tube and gently shaken for 5-10 seconds until thoroughly coated. Control treatments are prepared by adding equivalent volumes of sterile water to seeds.

Assay of Seedling Vigor:

Petri dishes are prepared by adding four sheets of sterile heavy weight seed germination paper, then adding either 50 mL of sterile water or, optionally, 50 ml of PEG solution as prepared above, to each plate then allowing the liquid to thoroughly soak into all sheets. The sheets are positioned and then creased so that the back of the plate and one side wall are covered, two sheets are then removed and placed on a sterile surface. Along the edge of the plate across from the covered side wall 15 inoculated wheat seeds are placed evenly at least one inch from the top of the plate and half an inch from the sides. Seeds are placed smooth side up and with the pointed end of the seed pointing toward the side wall of the plate covered by germination paper. The seeds are then covered by the two reserved sheets, and the moist paper layers smoothed together to remove air bubbles and secure the seeds, and then the lid is replaced. For each treatment, at least three plates with 15 seeds per plate are prepared. The plates are then randomly distributed into stacks of 8-12 plates and a plate without seeds is placed on the top. The stacks are incubated at 60% relative humidity, and 22° C. day, 18° C. night with 12 hours light and 12 hours dark for 24 hours, then each plate is turned to a semi-vertical position with the side wall covered by paper at the bottom. The plates are incubated for an additional 5 days, then wheat seeds are scored manually for germination, root and shoot length.

Statistical analysis is performed using R or a similar statistical software program.

Example 10. Method of Preparing Biomass for Field Trials

Preparation of Bacterial Endophytes

An agar plug of each bacterial strain is transferred using a transfer tube to 4 mL of potato dextrose broth (PDB) in a 24 well plate and incubated at room temperature at 675 rpm on a shaker for 3 days. After growth of bacteria in broth, 200 µl is transferred into a spectrophotometer reading plate and bacteria OD is read at 600 nm absorbance. All bacteria strains are then normalized to 0.05 OD utilizing PBS 1× buffer. Once desired dilutions are made, 3 µl of the bacteria solution is applied per seed, and mixed well by shaking in a sterile Falcon tube for 5-10 seconds.

Preparation of Fungal Endophytes

Preparation of molasses broth and potato dextrose agar: Molasses broth is prepared by dissolving 30 g molasses and 5 g yeast extract per liter deionized water in an autoclavable container and autoclaving (15 psi, 121° C.) for 45 min. Potato dextrose agar (PDA) plates are prepared by dissolving 39.0 g PDA powder per liter deionized water in an autoclavable container and autoclaving (15 psi, 121° C.) for 45 min. The agar is allowed to cool to 50-60° C., before pouring into sterile petri plates (30 mL per 90 mm plate).

Liquid biomass: All equipment and consumables are thoroughly sterilized and procedures performed in a biosafety cabinet. The inoculant is prepared by placing 1 plug from a cryopreserved stock on a fresh PDA plate, sealing the plate with Parafilm® and incubating at room temperature in the dark for 5-10 days. Then ~5×5 mm plugs are cut from the PDA plates and 10-12 plugs are transferred into flasks containing the sterile molasses broth, covered, secured in a shaker and incubated for at least 10 days with shaking at ~130 rpm. Then the culture is placed in a blender for 5 seconds and 1 mL of the blended was centrifuged and the supernatant is discarded and the pellet resuspended in 0.5 mL 1× Phosphate Buffered Saline (PBS) to generate inoculum.

Dry biomass: All equipment and consumables are thoroughly sterilized and procedures performed in a biosafety cabinet. The inoculant is prepared by placing 1 plug from a cryopreserved stock on a fresh PDA plate, sealing the plate with Parafilm® and incubating at room temperature in the dark for 5-10 days. Then ~5×5 mm plugs are cut from the PDA plates and 10-12 plugs are transferred into flasks containing the sterile molasses broth, covered, secured in a shaker and incubated for at least 10 days with shaking at ~130 rpm. In sterile conditions, the liquid culture is carefully decanted using 150 mm sterile filter paper on a sterilized Buchner funnel over a sterile flask. Once all liquid passes through the funnel, the pellet is rinsed with sterile water until the filtrate ran clear. When dry, the pellet is transferred to a drying cabinet and dried until brittle. The pellet is then ground into a fine powder, and sample is used to generate CFU counts.

Preparation of Sodium Alginate and Talc for Seed Treatments

A 2% weight/volume solution of sodium alginate for the seed coatings is prepared by the following method. An Erlenmeyer flask is filled with the appropriate volume of deionized water and warmed to 50 degrees Celsius on a heat plate with agitation using a stir bar. The appropriate mass of sodium alginate powder for the desired final concentration solution is slowly added until dissolved. The solution is autoclaved at 121 degrees Celsius at 15 PSI for 30 minutes to sterilize.

Talcum powder for the powdered seed coatings is prepared by the following method. Talcum powder is aliquoted into Ziploc bags or 50 mL Falcon tubes, and autoclaved in dry cycle (121 degrees Celsius at 15 PSI for 30 minutes) to sterilize.

Heterologous Disposition of Endophytes on Wheat Seeds

Wheat seeds are treated with commercial fungicidal and insecticidal treatments. Seeds are heterologously disposed to each endophyte according to the following seed treatment protocols for liquid or dry formulation.

Liquid formulation: The 2% sodium alginate solution prepared above is added to the seeds at a rate of 15 ml per kg of seeds. Liquid fungal culture as prepared in above is added to the seeds at a rate of 8.3 ml per kg of seeds. Control treatments are prepared using equivalent volumes of sterile broth. The seeds are then agitated to disperse the solution evenly on the seeds.

Then 12.5 g of talc powder per kg of seed is added and the seeds are agitated to disperse the powder evenly on the seeds. Then 17 ml per kg of seed of Flo-Rite® 1706 (BASF, Ludwigshafen, Germany) is added and the seeds are agitated to disperse the powder evenly on the seeds. The final concentration of endophyte is targeted to be at least $10^4$ CFU. Treated seeds are allowed to dry overnight in a well-ventilated space before planting.

Dry formulation: The 2% sodium alginate solution prepared above is added to the seeds at a rate of 20 ml per kg of seeds. Equal parts of the fungal dry biomass prepared as above and the talc prepared above are mixed. The solution is applied to the prepared seeds so that an equivalent of 12.5 g of fungal dry biomass is applied per kg of seeds. Control treatments are prepared using equivalent volumes of talc. The seeds are then agitated to disperse the solution evenly on the seeds.

Then 17 ml per kg of seed of Flo-Rite® 1706 (BASF, Ludwigshafen, Germany) is added and the seeds are agitated to disperse the powder evenly on the seeds. The final concentration of endophyte is targeted to be at least $10^4$ CFU. Treated seeds are allowed to dry overnight in a well-ventilated space before planting.

Heterologous Disposition of Endophytes on Soy Seeds

Soybean seeds of three varieties of soy seeds are treated with commercial fungicidal and insecticidal treatment CruiserMaxx® (Syngenta, Basel, Switzerland) per the manufacturer's instructions. Endophytes are heterologously disposed onto soybean seeds according to the following seed treatment protocols for liquid or dry formulation.

Liquid formulation: The 2% sodium alginate solution prepared above is added to the seeds at a rate of 8.3 ml per kg of seeds. Liquid fungal culture as prepared above is added to the seeds at a rate of 8.3 (fungal endophytes) or 8.4 (bacterial endophytes) ml per kg of seeds. Control treatments are prepared using equivalent volumes of sterile broth. The seeds were then agitated to disperse the solution evenly on the seeds. For fungal endophytes, 15 g per kg of seed of the talc powder prepared above is added and the seeds are agitated to disperse the powder evenly on the seeds. Then 13.3 (for fungal endophyte treatments) or 2.7 (for bacterial endophyte treatments) ml per kg of seed of Flo-Rite® 1706 (BASF, Ludwigshafen, Germany) is added and the seeds are agitated to disperse the powder evenly on the seeds. The final concentration of endophyte is targeted to be at least $10^4$ CFU. Treated seeds are allowed to dry overnight in a well-ventilated space before planting.

Dry fungal formulation: The 2% sodium alginate is added to the seeds at a rate of 16.6 ml per kg of seeds. Equal parts of the dry fungal biomass prepared as above and the talc prepared as above were mixed. The solution is applied so that an equivalent of 10 g of dry fungal biomass is applied per kg of seeds. Control treatments are prepared using equivalent volumes of talc. The seeds are then agitated to disperse the solution evenly on the seeds.

Then 13.3 ml per kg of seed of Flo-Rite® 1706 (BASF, Ludwigshafen, Germany) is added and the seeds are agitated to disperse the powder evenly on the seeds. The final concentration of endophyte is targeted to be at least $10^4$ CFU. Treated seeds are allowed to dry overnight in a well-ventilated space before planting.

Heterologous Disposition of Endophytes on Corn Seeds

Corn seeds are treated with commercial fungicidal and insecticidal treatment. Endophytes are heterologously disposed onto corn seeds according to the following seed treatment protocols for liquid or dry formulation.

Dry fungal formulation: The 2% sodium alginate solution prepared above is added to the seeds at a rate of 23 ml per kg of seeds. Equal parts of dry fungal biomass prepared as above and talc prepared as above are mixed. The solution is applied so that an equivalent of 10 g of fungal powder is applied per kg of seeds. Control treatments are prepared using equivalent volumes of talc. The seeds are then agitated to disperse the solution evenly on the seeds.

Then 16.6 ml per kg of seed of Flo-Rite® 1706 (BASF, Ludwigshafen, Germany) is added and the seeds are agitated to disperse the powder evenly on the seeds. The final concentration of endophyte is targeted to be at least $10^4$ CFU. Treated seeds are allowed to dry overnight in a well-ventilated space before planting.

Liquid formulation: Liquid culture as prepared above is added to the seeds at a rate of 23 (for fungal endophyte treatments) or 8.4 (for bacterial endophyte treatments) ml per kg of seeds, with equivalent volumes of the prepared sodium alginate. Control treatments are prepared using equivalent volumes of sterile broth. The seeds are then agitated to disperse the solution evenly on the seeds. For fungal endophytes, 15 g per kg of seed of talc powder as prepared above is added and the seeds are agitated to disperse the powder evenly on the seeds. Then 16.6 ml (for fungal endophyte treatments) or 2.4 ml (for bacterial endophyte treatments) per kg of seed of Flo-Rite® 1706 (BASF, Ludwigshafen, Germany) is added and the seeds are agitated to disperse the powder evenly on the seeds. The final concentration of endophyte is targeted to be at least $10^4$ CFU. Treated seeds are allowed to dry overnight in a well-ventilated space before planting.

Example 11. Assessment of Improved Plant Characteristics: Field Conditions

Wheat

Field trials are conducted, preferably, at multiple locations. Wheat seeds are treated with commercial fungicidal and insecticidal treatment. Seeds are heterologously disposed with the endophyte formulations and formulation control (lacking any endophyte) as described in Example 10, untreated seeds (lacking formulation and endophyte) are also planted. Seeds are sown in regularly spaced rows in soil at 1.2 million seeds/acre seeding density. At each location, at least 3 replicate plots are planted for each endophyte or control treatments in a randomized complete block design. For example, each plot may consist of seven, 15.24 m (40 ft.) rows.

At the end of the field trial employing endophyte treatment and control treatment plants, plots are harvested, for example machine harvested with a 5-ft research combine and yield is calculated by the on-board computer.

Corn

Field trials are conducted, preferably, at multiple locations. Plots may be irrigated, non-irrigated (dryland), or maintained with suboptimal irrigation at a rate to target approximately 25% reduction in yield. Seeds are prepared with the endophyte formulations and formulation control (lacking any endophyte) as described in Example 10. Seeds are sown in regularly spaced rows in soil at planting densities typical for each region. At each location, at least 3 replicate plots are planted per endophyte or control treatment in a randomized complete block design. For examples, each plot may consist of four 15.24 m (40 ft.) rows, each separated by 76.2 cm (30 in).

At the end of the field trial employing endophyte treatment and control treatment plants, plots are harvested, for example, machine harvested with a 5-ft research combine and yield is calculated by the on-board computer. Only the middle two rows of the 4 row plots are harvested to present border effects.

Soy

Field trials are conducted, preferably, at multiple locations. Seeds were prepared with the endophyte formulations and formulation control (lacking any endophyte) as described in Example 10. Seeds are sown in regularly spaced rows in soil at planting densities typical for each region, for example, at 180,000 seeds/acre seeding density. At each location at least 3 replicate plots are planted per endophyte or control treatment in a randomized complete block design). For examples, each plot may consist of four 15.24 m (40 ft.) rows, each separated by 76.2 cm (30 in).

At the end of the field trial employing endophyte treatment and control treatment plants, plots are harvested, for example, machine harvested with a 5-ft research combine and yield is calculated by the on-board computer. Only the middle two rows of the 4 row plots are harvested to present border effects.

Assay of Seed Yield Under Field Conditions, Canola

Field trials are conducted at multiple locations, preferably in diverse geographic regions. Plots may be irrigated, non-irrigated (dryland) or maintained with suboptimal irrigation at a rate to target approximately 25% reduction in yield. Canola seeds are treated with commercial fungicidal and insecticidal treatment. Seeds are prepared with the liquid endophyte formulations and liquid formulation control (lacking any endophyte) as described in Example 10 and untreated seeds (lacking formulation and endophyte) are also planted. At each location, at least 3 replicate plots are planted for each endophyte or control treatment in a randomized complete block design.

At the end of the field trial employing endophyte treatment and control treatment plants, plots are harvested, for example, machine harvested with a 5-ft research combine and yield is calculated by the on-board computer.

Assay of Seed Yield Under Field Conditions, Peanut

Field trials are conducted at multiple locations, preferably in diverse geographic regions. Plots were non-irrigated (dryland) or maintained with suboptimal irrigation at a rate to target approximately 25% reduction in yield. Peanut seeds are treated with commercial fungicidal and insecticidal treatment. Seeds were prepared with either the endophyte formulations and formulation control (lacking any endophyte) as described in Example 10 and untreated seeds (lacking formulation and endophyte) are also planted.

At the end of the field trial employing endophyte treatment and control treatment plants, plots are harvested, for example, machine harvested with a 5-ft research combine and yield is calculated by the on-board computer.

Example 12. Additional Methods for Creating Synthetic Compositions

Osmopriming and Hydropriming

A fungal or bacterial endophyte is inoculated onto seeds during the osmopriming (soaking in polyethylene glycol solution to create a range of osmotic potentials) and/or hydropriming (soaking in de-chlorinated water) process. Osmoprimed seeds are soaked in a polyethylene glycol solution containing a bacterial and/or fungal endophyte for one to eight days and then air dried for one to two days. Hydroprimed seeds are soaked in water for one to eight days containing a bacterial and/or fungal endophyte and maintained under constant aeration to maintain a suitable dissolved oxygen content of the suspension until removal and air drying for one to two days. Talc and or flowability polymer are added during the drying process.

Foliar Application

A fungal or bacterial endophyte is inoculated onto aboveground plant tissue (leaves and stems) as a liquid suspension in dechlorinated water containing adjuvants, sticker-spreaders and UV protectants. The suspension is sprayed onto crops with a boom or other appropriate sprayer.

Soil Inoculation

A fungal or bacterial endophyte is inoculated onto soils in the form of a liquid suspension either; pre-planting as a soil drench, during planting as an in-furrow application, or during crop growth as a side-dress. A fungal or bacterial endophyte is mixed directly into a fertigation system via drip tape, center pivot or other appropriate irrigation system.

Hydroponic and Aeroponic Inoculation

A fungal or bacterial endophyte is inoculated into a hydroponic or aeroponic system either as a powder or liquid suspension applied directly to the rockwool substrate, or applied to the circulating or sprayed nutrient solution.

Vector-Mediated Inoculation

A fungal or bacterial endophyte is introduced in power form in a mixture containing talc or other bulking agent to the entrance of a beehive (in the case of bee-mediation) or near the nest of another pollinator (in the case of other insects or birds. The pollinators pick up the powder when exiting the hive and deposit the inoculum directly to the crop's flowers during the pollination process.

Root Wash

The method includes contacting the exterior surface of a plant's roots with a liquid inoculant formulation containing a purified bacterial population, a purified fungal population, or a mixture of purified bacteria and fungi. The plant's roots are briefly passed through standing liquid microbial formulation or liquid formulation is liberally sprayed over the roots, resulting in both physical removal of soil and microbial debris from the plant roots, as well as inoculation with microbes in the formulation.

Seedling Soak

The method includes contacting the exterior surfaces of a seedling with a liquid inoculant formulation containing a purified bacterial population, a purified fungal population, or a mixture of purified bacteria and fungi. The entire seedling is immersed in standing liquid microbial formulation for at least 30 seconds, resulting in both physical removal of soil and microbial debris from the plant roots, as well as inoculation of all plant surfaces with microbes in the formulation. Alternatively, the seedling can be germinated from seed in or transplanted into media soaked with the microbe(s) of interest and then allowed to grow in the media, resulting in soaking of the plantlet in microbial formulation for much greater time totaling as much as days or weeks. Endophytic microbes likely need time to colonize and enter the plant, as they explore the plant surface for cracks or wounds to enter, so the longer the soak, the more likely the microbes will successfully be installed in the plant.

Wound Inoculation

The method includes contacting the wounded surface of a plant with a liquid or solid inoculant formulation containing a purified bacterial population, a purified fungal population, or a mixture of purified bacteria and fungi. Plant surfaces are designed to block entry of microbes into the endosphere, since pathogens attempting to infect plants in this way. One way to introduce beneficial endophytic microbes into plant endospheres is to provide a passage to the plant interior by wounding. This wound can take a number of forms, including pruned roots, pruned branches, puncture wounds in the stem breaching the bark and cortex, puncture wounds in the tap root, puncture wounds in leaves, puncture wounds seed allowing entry past the seed coat. Wounds can be made using tools for physical penetration of plant tissue such as needles. Microwounds may also be introduced by sonication. Into the wound can then be contacted the microbial inoculant as liquid, as powder, inside gelatin capsules, in a pressurized capsule injection system, in a pressurized reservoir and tubing injection system, allowing entry and colonization by microbes into the endosphere. Alternatively, the entire wounded plant can be soaked or washed in the microbial inoculant for at least 30 seconds, giving more microbes a chance to enter the wound, as well as inoculating other plant surfaces with microbes in the formulation—for example pruning seedling roots and soaking them in inoculant before transplanting is a very effective way to introduce endophytes into the plant.

Injection

The method includes injecting microbes into a plant in order to successfully install them in the endosphere. Plant surfaces are designed to block entry of microbes into the endosphere, since pathogens attempting to infect plants in this way. In order to introduce beneficial endophytic microbes to endospheres, we need a way to access the interior of the plant which we can do by puncturing the plant surface with a need and injecting microbes into the inside of the plant. Different parts of the plant can be inoculated this way including the main stem or trunk, branches, tap roots, seminal roots, buttress roots, and even leaves. The injection can be made with a hypodermic needle, a drilled hole injector, or a specialized injection system, and through the puncture wound can then be contacted the microbial inoculant as liquid, as powder, inside gelatin capsules, in a pressurized capsule injection system, in a pressurized reservoir and tubing injection system, allowing entry and colonization by microbes into the endosphere.

Example 13. Identification of Unique Genes in an Endophyte of Interest

Whole genome analysis of endophytes can be used to identify genes whose presence, absence or over or under representation ("differential abundance") are associated with desirable phenotypes. To identify genes with differential abundance in the genome of an endophyte of interest, protein sequences predicted from the genomes of the endophyte and closely related species compared in an all-vs-all pairwise comparison (for example, using BLAST) followed by clustering of the protein sequences based on alignment scores (for example, using MCL: Enright A. J., Van Dongen S., Ouzounis C. A. An efficient algorithm for large-scale detection of protein families. Nucleic Acids Research 30(7): 1575-1584 (2002)). Additional software tools useful for this analysis are well known in the art and include OMA, OrthoMCL and TribeMCL (Roth A C, Gonnet G H, Dessimoz C. Algorithm of OMA for large-scale orthology inference. BMC Bioinformatics. 2008; 9:518. doi: 10.1186/1471-2105-9-518, Enright A J, Kunin V, Ouzounis C A. Protein families and TRIBES in genome sequence space. Nucleic Acids Res. 2003; 31(15):4632-8.; Chen F, Mackey A J, Vermunt J K, Roos D S. Assessing performance of orthology detection strategies applied to eukaryotic genomes. PLoS One. 2007; 2(4):e383.). The protein clusters are queried to identify clusters with differential abundance of proteins derived from endophytes having desirable phenotypes. Proteins of these clusters define the unique properties of these endophytes, and the abundance of genes encoding these proteins may be used to identify endophytes of the present invention.

Example 14: Increased Uptake of *Bradyrhizobium* in Legumes

The methods of the present invention provide for determination of a beneficial treatment by profiling the microbial communities of the selected plants. One method of profiling is to detect the abundance of a marker gene by qPCR. In the present example, plants are treated, for example by inoculation with an endophyte treatment, and grown in the presence of a Rhizobiales, for example a *Bradyrhizobium* such as MIC-96574 comprising sequences with substantial homology to SEQ ID NOs: 513 or 522. The *Bradyrhizobium* may be co-inoculated with an endophyte treatment. The plant tissue is then harvested and profiled by qPCR using *Bradyrhizobium*-specific primers. In some embodiments, the primers may be universal primers suitable for amplification of the recA gene in *Bradyrhizobium* such as TSrecAf (5'-CAACTGCMYTGCGTATCGTCGAAGG-3') (SEQ ID NO: 638) and TSrecAr (5'-CGGATCTGGTTGATGAA-GATCACCATG-3') (SEQ ID NO: 637) (Menna et al Int J Syst Evol Microbiol. 2009 December; 59(Pt 12):2934-50).

In some embodiments, the primers may be suitable for amplification of the recA gene in MIC-96574 such as (5'-CGGTGTCCTCCGGTTCT-3') (SEQ ID NO: 640) and (5'-GTAGATTTCCACGACGCGC-3') (SEQ ID NO: 641). A probe may be used in a qPCR method to increase specificity, for example a probe for detection of the recA gene in MIC-96574 such as (5'-TCGGGCTCGACAT-TGCACTG-3'). Beneficial treatments are identified by an enrichment, in treated plants, of *Bradyrhizobium* relative plants grown in the same conditions which had not been treated with the endophyte treatment.

*Bradyrhizobium* solution preparation: The bacteria, *Bradyrhizobium japonicum*, is inoculated in 100 mL of yeast mannitol broth ("YMB"). Seven days after growth of the bacteria in broth, it is spun down and resuspended utilizing PBS 1× buffer. OD is read at 600 nm absorbance and normalized to 0.01. Dilute *Bradyrhizobium* solution is prepared with sterile water, for example a 1:100 dilution or a 1:10,000 dilution. Serial dilutions of *Bradyrhizobium* solution are prepared in sterile water and plated on yeast mannitol agar plates to determine colony forming units.

Sterile glass jars are prepared in triplicate for each endophyte treatment, control treatments which include endophyte treatments to which no *Bradyrhizobium* solution is added, and control treatments including no endophyte (a formulation control) to which no *Bradyrhizobium* solution is added. Each jar contains two sheets of sterile germination paper. The germination paper in the treatment jars is moistened with 60 mL of the dilute *Bradyrhizobium* solution, 60 mL of sterile water is added to the germination paper in jars for the controls.

Endophyte treatment cultures are spun down and resuspended in 1×PBS and normalized to an OD600 of 0.05. Endophyte treated seeds are prepared by adding 3 µl of the endophyte treatment solution to each seed. Alternately, the endophyte treatment many consist of spores which are applied to seeds using a 3 µl of a spore suspension comprising 10^6 spores/mL. Seeds are prepared for the no-endophyte controls by adding 3 µl 1×PBS to each seed. Twelve seeds for each replicate are evenly distributed 1.75 inches from the top of one piece of the germination paper. The second germination paper is placed on top of the seeds. Germination papers are rolled gently using a 50 mL Falcon tube in the middle as a guide for the hole. The Falcon tube is removed and the rolled papers are secured with a rubber band.

Assay of seedling vigor: Jars are randomly distributed in a grow room for seedling germination. After five days, the lids of the jars are removed. Two days after removing the lids the plants are watered with 15 mL of sterile water/jar. Ten days after planting the roots of seedlings are removed and weighed. Each root is added to a tube containing two 7 mm steal beads and 5 mL of 1×PBS in a sterile 15 mL tube. The tissue is then homogenized on a FastPrep tissue homogenizer (MP Biomedicals Santa Ana, CA). 1.8 mL of tissue homogenate is added to a 2 mL tube containing 100 mg of Qiagen 0.1 mm glass beads. DNA is extracted using the Omega Mag-Bind® Plant DNA DS 96 Kit according to manufacturer's protocol.

Profiling of *Bradyrhizobium* Abundance.

The presence and abundance of *Bradyrhizobium* in endophyte treated seedlings and control seedlings (no endophyte treatment) grown in the presence of the *Bradyrhizobium* solution are detected by qPCR using *Bradyrhizobium*-specific RecA primers. Purified genomic DNA of at least 10 ng/µl is prepared from the homogenized samples collected above. Primer used in qPCR are first tested for background signal from each plant variety used in order to determine if primers cross-react with DNA from plant material and whether the plant DNA inhibits amplification of RecA. Serial dilutions of RecA gene amplicons at concentrations of 10 ng/µl, 5 ng/µl, 1 ng/µl, 0.1 ng/µl, 0.01 ng/µl, 0.001 ng/µl, and 0.0001 ng/µl are prepared, duplicates of each sample and a negative control (no DNA) are prepared.

Master mix sufficient for the number of samples plus 2 reactions are prepared using the reagents in Table 16, Luna. Universal Probe qPCR Master Mix is available from New England Biolabs, Ipswich MA

TABLE 16

| Reagent volume per qPCR | |
| --- | --- |
| Reagent | Volume per Rx |
| New England Biolabs: Luna Universal Probe qPCR Master Mix | 10 µl |
| F. Primer {10 µM} | 0.8 µl |
| R. Primer {10 µM} | 0.8 µl |
| Probe | 0.4 µl |
| Template DNA | 1 µl |
| Ultrapure water | 7 µl |

Each reaction is prepared then placed in a Bio-Rad CFX96 qPCR machine (Bio-Rad Laboratories, Hercules, CA), and run with the following cycles (Table 17) and the fluorophore set to FAM.

TABLE 17

| qPCR program | | |
| --- | --- | --- |
| Temperature | Time | Cycles |
| 95° C. | 1 minute | 1 cycle |
| 95° C. | 15 seconds | Cycles repeated for 40 cycles |
| 60° C. | 30 seconds | |

When the qPCR run is complete, the onboard software is utilized to select the wells with the negative controls and wells containing the serial dilution samples and generate a standard curve. Then the cycle threshold (Ct) for each sample is determined. Samples treated with beneficial treatments are expected to have lower Ct values than control seedlings (no endophyte treatment) grown in the presence of the *Bradyrhizobium* solution.

Having illustrated and described the principles of the present invention, it should be apparent to persons skilled in the art that the invention can be modified in arrangement and detail without departing from such principles. It is to be understood that while the invention has been described in conjunction with the detailed description thereof, the foregoing description is intended to illustrate and not limit the scope of the invention, which is defined by the scope of the appended claims. Other embodiments, advantages, and modifications are within the scope of the following claims.

SEQUENCE LISTING (642 sequences)

SEQ ID NO: 1 - DNA, 20 bp, Unknown
  16S primer - 27f
agagtttgatymtggctcag

SEQ ID NO: 2 - DNA, 19 bp, Unknown
  16S primer -1492r
ggttaccttgttacgactt

SEQ ID NO: 3 - DNA, 19 bp, Unknown
  16S primer -515f
gtgccagcmgccgcggtaa

SEQ ID NO: 4 - DNA, 20 bp, Unknown
  16S primer -806r
ggactachvgggtwtctaat

SEQ ID NO: 5 - DNA, 254 bp, Novosphingobium rosa
atacggagggagctagcgttgttcggaattactgggcgtaaagcgcacgtaggcggtacatcaagtcaggggtgaaagcccggagctcaactccggaactgcccttgaaactagtgtactagaatcttggagaggcgggtggaattccgagtgtagaggtgaaattcgtagatattcggaagaacaccagtggcgaaggcggcccgctggacaagtattgacgctgaggtgcgaaagcgtggggagcaaacagg

SEQ ID NO: 6 - DNA, 254 bp, Rhizobium huautlense
atacgaagggggctagcgttgttcggaattactgggcgtaaagcgcacgtaggcggatatttaagtcagaggtgaaatcccggagctcaacttcggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 7 - DNA, 254 bp, Unknown
  Kingdom: Bacteria, Phylum: Proteobacteria, Class: Alphaproteobacteria, Order: Rhizobiales, Family: Methylobacteriaceae, Genus: Methylobacterium
atacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacagg

SEQ ID NO: 8 - DNA, 254 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
atacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 9 - DNA, 254 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
atacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 10 - DNA, 254 bp, Unknown
  Kingdom: Bacteria, Phylum: Proteobacteria, Class: Alphaproteobacteria, Order: Rhizobiales, Family: Bradyrhizobiaceae, Genus: Bradyrhizobium
atacgaagggggctagcgttgctcggaatcactgggcgtaaagggtgcgtaggcgggtttttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacagg

SEQ ID NO: 11 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggagctagcgttattcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 12 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggagctagcgttattcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 13 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggagctagcgttgttcggaattactgggcgtaaagcgcacgtaggcggctttgtaagttagaggtgaaagcctggagctcaactccagaattgcctttgatactgcatggcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 14 - DNA, 254 bp, Unknown
  Kingdom: Bacteria, Phylum: Proteobacteria, Class: Alphaproteobacteria, Order: Rhodobacterales, Family: Rhodobacteraceae
atacggagggggctagcgttattcggaattactgggcgtaaagcgcacgtaggcggattggaaagtcagaggtgaaatcccagagctcaactttggaactgcctttgaaactcccagtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 15 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 16 - DNA, 254 bp, Caulobacter vibrioides
atacgaagggggctagcgttgctcggaattactgggcgtaaagggagcgtaggcggactgttaagttagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 17 - DNA, 254 bp, Methylobacterium adhaesivum
atacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaacactgacgctgaggcgcgaaagcgtggggagcaaacagg

SEQ ID NO: 18 - DNA, 254 bp, Novosphingobium capsulatum
atacggagggagctagcgttgttcggaattactgggcgtaaagcgcacgtaggcggttactcaagtcagaggtgaaagcccggggctcaaccccggaactgcctttgaaactaggtgactggaatcttggagaggcgagtggaattccgagtgtagaggtgaaattcgtagatattcggaagaacaccagtggcgaaggcgactcgctggacaagtattgacgctgaggtgcgaaagcgtggggagcaaacagg

SEQ ID NO: 19 - DNA, 254 bp, Sphingomonas kaistensis
atacggagggggctagcgttgttcggaattactgggcgtaaagcgcacgtaggcggctttgtaagttagaggtgaaagcccggagcttaactccggaactgcctttaagactgcatcgcttgaatcatggagaggtcagtggaattccgagtgtagaggtgaaattcgtagatattcggaagaacaccagtggcgaaggcgactgactggacatgtattgacgctgaggtgcgaaagcgtggggagcaaacagg

SEQ ID NO: 20 - DNA, 254 bp, Unknown
  Kingdom: Bacteria, Phylum: Proteobacteria, Class: Alphaproteobacteria, Order: Rhodospirillales, Family: Rhodospirillaceae, Genus: Inquilinus
atacgaagggggcaagcgttgttcggaatgactgggcgtaaagggcgcgtaggcggttcgttgcgtcagatgtgaaagccccgggctcaacctgggaactgcatttgatacgggcgggcttgaatccaagagagggtggtggaattcccagtgtagaggtgaaattcgtagatattgggaagaacaccagtggcgaaggcggccacctggcttggtattgacgctgaggcgcgaaagcgtggggagcaaacagg

SEQ ID NO: 21 - DNA, 254 bp, Unknown
  Kingdom: Bacteria, Phylum: Proteobacteria, Class: Alphaproteobacteria, Order: Rhizobiales, Family: Methylobacteriaceae, Genus: Methylobacterium
atacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacagg

SEQ ID NO: 22 - DNA, 254 bp, Unknown
  Kingdom: Bacteria, Phylum: Proteobacteria, Class: Alphaproteobacteria, Order: Caulobacterales, Family: Caulobacteraceae, Genus: Caulobacter
atacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 23 - DNA, 254 bp, Unknown
  Kingdom: Bacteria, Phylum: Proteobacteria, Class: Alphaproteobacteria, Order: Rhizobiales, Family: Methylobacteriaceae, Genus: Microvirga
atacgaagggggctagcgttgttcggaatcactgggcgtaaagggcgcgtaggcggctttgtaagtcgggggtgaaagcctgtggctcaaccacagaattgccttcgatactgcatggcttgagaccggaagaggttagtggaactgcgagtgtagaggtgaaattcgtagatattcgcaagaacaccagtggcgaaggcggctgactggtccggatctgacgctgaggcgcgaaagcgtggggagcaaacagg

SEQ ID NO: 24 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctagcgttgttcggaattactgggcgtaaagcgcacgtaggcggataattaagtcaggggtgaaatcccgcagctcaactgcggaactgcctttgatactggttatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 25 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccataactgacgctgaggtgcgaaagcgtggggagcaaacagg

SEQ ID NO: 26 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 27 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccataactgacgctgaggtgcgaaagcgtggggagcaaacagg

SEQ ID NO: 28 - DNA, 254 bp, Unknown
  Kingdom: Bacteria, Phylum: Proteobacteria, Class: Alphaproteobacteria, Order: Rhizobiales, Family: Xanthobacteraceae, Genus: Labrys
atacgaagggggctagcgttgttcggaattactgggcgtaaagcgcacgtaggcggattgttaagtcgggggtgaaatcctgaggctcaacctcagaactgccttcgatactggcgatcttgagttcggaagaggttggtggaacagctagtgtagaggtgaaattcgtagatattagctagaacaccagtggcgaaggcggccaactggtccgatactgacgctgaggtgcgaaagcgtggggagcaaacagg

SEQ ID NO: 29 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctggcgttgttcggaattactgggcgtaaagcgcacgtaggcggacatttaagtcagaggtgaaatcccggagctcaacttcggaactgcctttgatactgggtgtcttgagtatggaagaggttagtggaattgcgagtgtagaggtgaaattcgtagatattcgcaggaacaccagtggcgaaggcggctaactggtccataactgacgctgaggtgcgaaagcgtggggagcaaacagg

SEQ ID NO: 30 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacagg

SEQ ID NO: 31 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggagctagcgttgttcggaattactgggcgtaaagcgcacgtaggcggctttgtaagtaagaggtgaaagcctggagctcaactccagaactgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 32 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggagctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 33 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggagctagcgttgttcggaattactgggcgtaaagcgcacgtaggcggctttgtaagttagaggtgaaagcctggagcttaactccagaattgcctttaagactgcatcgcttgaatccgggagaggtgagtggaattccgagtgtagaggtgaaattcgtagatattcggaagaacaccagtggcgaaggcggctcactggaccggtattgacgctgaggtgcgaaagcgtggggagcaaacagg

SEQ ID NO: 34 - DNA, 254 bp, Unknown
  Kingdom: Bacteria, Phylum: Proteobacteria, Class: Alphaproteobacteria, Order: Sphingomonadales, Family: Erythrobacteraceae, Genus: Porphyrobacter
atacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacagg

SEQ ID NO: 35 - DNA, 254 bp, Unknown
  Kingdom: Bacteria, Phylum: Proteobacteria, Class: Alphaproteobacteria, Order: Sphingomonadales, Family: Sphingomonadaceae, Genus: Novosphingobium
atacggagggagctagcgttgttcggaattactgggcgtaaagcgcgcgtaggcggcgacacaagtcagaggtgaaagcccggggctcaaccccggaactgcctttgaaactaggttgctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 36 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttattcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 37 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttattcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 38 - DNA, 254 bp, Unknown
  Kingdom: Bacteria, Phylum: Proteobacteria, Class: Alphaproteobacteria, Order: Rhodobacterales, Family: Rhodobacteraceae, Genus: Paracoccus
atacggagggggctagcgttgttcggaattactgggcgtaaagcgcacgtaggcggaccagaaagttggaggtgaaatcccagggctcaaccttggaactgccttcaaaactattggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 39 - DNA, 254 bp, Unknown
  Kingdom: Bacteria, Phylum: Proteobacteria, Class: Alphaproteobacteria, Order: Rhodobacterales, Family: Rhodobacteraceae, Genus: Gemmobacter
atacggagggggctagcgttgttcggaattactgggcgtaaagcgcacgtaggcggaccggaaagtcagaggtgaaatcccagggctcaaccttggaactgcctttgaaactcctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 40 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingobium
atacggagggggctagcgttgttcggaattactgggcgtaaagcgcacgtaggcggcgatttaagtcagaggtgaaagcccggggctcaaccccggaactgcctttgagactggattgctagaatcttggagaggcgggtggaattccgagtgtagaggtgaaattcgtagatattcggaagaacaccagtggcgaaggcggcccgctggacaagtattgacgctgaggtgcgaaagcgtggggagcaaacagg

SEQ ID NO: 41 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgcgaaagcgtggggagcaaacagg

SEQ ID NO: 42 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagttagaggtgaaagcccggagctcaactccggaactgcctttaagactgcatcgcttgaatcatggagaggttagtggaattccgagtgtagaggtgaaattcgtagatattcggaagaacaccagtggcgaaggcgactaactggacatgtattgacgctgaggtgcgaaagcgtggggagcaaacagg

SEQ ID NO: 43 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagttagaggtgaaagcccggagcttaactccggaactgcctttaagactgcatcgcttgaatcatggagaggttagtggaattccgagtgtagaggtgaaattcgtagatattcggaagaacaccagtggcgaaggcgactaactggacatgtattgacgctgaggtgcgaaagcgtggggagcaaacagg

SEQ ID NO: 44 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagttagaggtgaaagcccggggctcaactccggaactgcctttaagactgcatcgctagaatcatggagaggtcagtggaattccgagtgtagaggtgaaattcgtagatattcggaagaacaccagtggcgaaggcgactgactggacatgtattgacgctgaggtgcgaaagcgtggggagcaaacagg

SEQ ID NO: 45 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagttagaggtgaaagcccggggctcaactccggaactgcctttaagactgcatcgcttgaatcatggagaggttagtggaattccgagtgtagaggtgaaattcgtagatattcggaagaacaccagtggcgaaggcgactaactggacatgtattgacgctgaggtgcgaaagcgtggggagcaaacagg

SEQ ID NO: 46 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgtacgtaggcggttttgtaagttagaggtgaaagcccggagctcaacttcggaattgcctttaagactgcatcacttgaacgtcggagaggtgagtggaattccgagtgtagaggtgaaattcgtagatattcggaagaacaccagtggcgaaggcggctcactggacgactgttgacgctgaggtacgaaagcgtggggagcaaacagg

SEQ ID NO: 47 - DNA, 240 bp, Unknown
  Kingdom: Bacteria, Phylum: Proteobacteria, Class: Alphaproteobacteria
tacgaagggagctagcgttgttcggaattactgggcgtaaagggtgcgtaggctgtttaataagttagatgtgaaagcctcggtttcaagctgagaatagcatttaatactgttagactagaggataagagaggatagtggaattctgagtgtagaggtaaaattcgtagatattcggaggaacaccagaggcgaaagcgtctatctggattaatcctaacgctgaggcacgaaagtatg

SEQ ID NO: 48 - DNA, 251 bp, Unknown
  Kingdom: Bacteria, Phylum: Proteobacteria, Class: Alphaproteobacteria, Order: Sphingomonadales, Family: Sphingomonadaceae, Genus: Sphingomonas
tacggagggggctagcgttgttcggaattactgggcgtaaagcgcacgtaggcggctttgtaagttagaggtgaaagcccagagctcaactctggaactgcctttaagactgcatcgcttgaatcatggagaggttagtggaattccgagtgtagaggtgaaattcgtagatattcggaagaacaccagtggcgaaggcgactaactggacatattgacgctgaggtgcgaaagcgtggggagcaaacagg

SEQ ID NO: 49 - DNA, 254 bp, Chthoniobacter flavus
atacagaggtctcaagcgttgttcggattcattgggcgtaaagggtgcgtaggtggcgccataagtcaggtgtgaaatctcggggctcaaccccgaaactgcacttgatactgtggtgctcgagtactggagaggagattggaatttacggtgtagcagtgaaatgcgtagatatcgtaaggaagaccagtggcgaaggcgaatctctggacagttactgacactgaggcacgaaggccaggggagcaaacggg

SEQ ID NO: 50 - DNA, 254 bp, Methylobacterium aquaticum
atacgaagggggctagcgttgctcggaatcactgggcgtaaagggcgcgtaggcggctgatttagtcgagggtgaaagcccgtggctcaaccacggaatggccttcgatactgattggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacagg

SEQ ID NO: 51 - DNA, 254 bp, Sediminibacterium salmoneum
atacggagggtgcaagcgttatccggattcactgggtttaaagggtgcgtaggcgggtatttaagtcagtggtgaaatcctagagcttaactctagaactgccattgatactatttatcttgaatattgtggaggtaagcggaatatgtcatgtagcggtgaaatgcttagatatgacatagaacacctattgcgaaggcagcttactacgcatatattgacgctgaggcacgaaagcgtggggatcaaacagg

SEQ ID NO: 52 - DNA, 254 bp, Sphingomonas jaspsi
atacggagggggctagcgttgttcggaattactgggcgtaaagcgcgcgtaggcggctttgtaagttagaggtgaaagcccggagcttaactccggaactgcctttaagactgcatcgctagaatcgtggagaggtgagtggaattccgagtgtagaggtgaaattcgtagatattcggaagaacaccagtggcgaaggcgactcactggacacgtattgacgctgaggtgcgaaagcgtggggagcaaacagg

SEQ ID NO: 53 - DNA, 254 bp, Streptomyces indicus
atacgtagggcgcaagcgttgtccggaattattgggcgtaaagagctcgtaggcggccagtcgcgtcgggtgtgaaagaccggggcttaaccccggttctgcattcgatacgggctggctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 54 - DNA, 254 bp, Variovorax paradoxus
atacgtagggtgcaagcgttaatcggaattactgggcgtaaagcgtgcgcaggcggtgatgtaagacagttgtgaaatccccgggctcaacctgggaactgcatctgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 55 - DNA, 254 bp, Unknown
  Kingdom: Bacteria, Phylum: Planctomycetes, Class: Planctomycetacia, Order: Planctomycetales, Family: Planctomycetaceae
agacgaaccgtccaaacgttattcggaattactgggcttaaagggtgcgtaggcggcgcggaaagttgggtgtgaaatccctcggctcaaccgaggaactgcgctcaatactgccgtgctcgagggagatagaggtgagcggaacttagggtggagcggtgaaatgcgttgatatcctaaggaacaccggtggcgaaagcggctcactggatctcttctgacgctgaggcacgaaagctagggtagcaaacggg

SEQ ID NO: 56 - DNA, 254 bp, Unknown
  Kingdom: Bacteria, Phylum: Cyanobacteria, Class: Cyanobacteria, Order: SubsectionIII, Family: FamilyI, Genus: Planktothrix
agacggaggaggcaagcgttatccggaatgattgggcgtaaagagtccgtaggtggaacttcaagtctattgttaaagagcaaagcttaactttgtaaaggcagtggaaactgaagaactagagaggggcaggggcaaagggaattcctggtgtagcggtgaaatgcgtagagatcaggaagagcaccggtggcgaaagcgctttgctgggcccattctgacactgagggacgaaagctaggggagcgaatggg

SEQ ID NO: 57 - DNA, 254 bp, Unknown
  Kingdom: Bacteria, Phylum: Actinobacteria, Class: Actinobacteria, Order: Micromonosporales, Family: Micromonosporaceae, Genus: Catenuloplanes
agacgtagggtgcgagcgttgtccggatttattgggcgtaaagagctcgtaggcggcttgtcgcgtcgaatgtgaaatcccgtggctcaactgcgggtctgcattcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 58 - DNA, 254 bp, Unknown
  Kingdom: Bacteria, Phylum: Acidobacteria, Class: Acidobacteria_Gp6, Order: Gp6, Family: Gp6, Genus: Gp6
atacagagggggcaagcgttgttcggaattactgggcgtaaagggcgcgtaggcggccgcctaagtcagacgtgaaatccctcggctcaaccggggaactgcgtctgatactgggtggcttgaatccgggagagggatgcggaattccaggtgtagcggtgaaatgcgtagatatctggaggaacaccggtggcgaaggcggcatcctggaccggcattgacgctgaggcgcgaaagccaggggagcaaacggg

SEQ ID NO: 59 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacagagggtgcaagcgttaatcggaattactgggcgtaaagcgcgcgtaggtggttcgttaagttgaatgtgaaagccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacagg

SEQ ID NO: 60 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacagagggtgcaagcgttaatcggaattactgggcgtaaagcgcgcgtaggtggtttgttaagttgaatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacagg

SEQ ID NO: 61 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 62 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacagagggtgcaagcgttaatcggaattactgggcgtaaagcgcgcgtaggtggtttgttaagttggatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacagg

SEQ ID NO: 63 - DNA, 254 bp, Unknown
  Kingdom: Bacteria, Phylum: Proteobacteria, Class: Gammaproteobacteria, Order: Pseudomonadales, Family: Moraxellaceae, Genus: Acinetobacter
atacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacagg

SEQ ID NO: 64 - DNA, 254 bp, Unknown
  Kingdom: Bacteria, Phylum: Planctomycetes, Class: Planctomycetacia, Order: Planctomycetales, Family: Planctomycetaceae, Genus: Planctomyces
atacgaactgtgcgaacgttattcggaatcactgggcttacagggtgcgtaggcggcctttcaagtcaggtgtgaaagcccccggctcaaccggggaactgcgcttgaaactgaaaggctcgagtcagctagaggtgcacggaacttccagtggagcggtgaaatgtgttgatattggaaggaacaccggaggcgaaagcggtgcactggggctggtctgacgctgaggcacgaaagccaggggagcgaacggg

SEQ ID NO: 65 - DNA, 255 bp, Unknown
  Kingdom: Bacteria, Phylum: Proteobacteria, Class: Alphaproteobacteria, Order: Rhizobiales, Family: A0839
atacgaagggggctagcgttgttcggaattactgggcgtaaagcgcgcgtaggcggttttgcaagccagaggtgaaatgcctgagcttaacttaggaattgcctttgggactgcgaggctttgaggacgggagaggtgagtggaattcccagtgtagaggtgaaattcgtagatattgggaagaacaccggtggcgaaggcggctcactggcccgtttctgacgctgtagcgcgaaagcgtggggatcaaacagg

SEQ ID NO: 66 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacagg

SEQ ID NO: 67 - DNA, 255 bp, Unknown
  Kingdom: Bacteria, Phylum: Proteobacteria, Class: Gammaproteobacteria, Order: Pseudomonadales, Family: Pseudomonadaceae, Genus: Pseudomonas
  misc_feature (86)..(86): n is a, c, g, or t
atacgaagggtgcaagcgttaatcggaattactgggcgtaaagcgcgcgtaggtggcttgataagttggatgtgaaatccccgggnctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacagg

SEQ ID NO: 68 - DNA, 254 bp, Unknown
  Kingdom: Bacteria, Phylum: Proteobacteria, Class: Gammaproteobacteria, Order: Xanthomonadales, Family: Xanthomonadaceae, Genus: Stenotrophomonas
atacgaagggtgcaagcgttactcggaattactgggcgtaaagcgtgcgtaggtggttgtttaagtctgttgtgaaagccctgggctcaacctgggaattgcagtggatactgggcgactagagtgtggtagagggtagtggaattcccggtgtagcagtgaaatgcgtagagatcgggaggaacatccatggcgaaggcagctacctggaccaacactgacactgaggcacgaaagcgtggggagcaaacagg

SEQ ID NO: 69 - DNA, 254 bp, Unknown
  Kingdom: Bacteria, Phylum: Bacteroidetes, Class: Flavobacteriia, Order: Flavobacteriales, Family: Flavobacteriaceae, Genus: Flavobacterium
atacggaggatccaagcgttatccggaatcattgggtttaaagggtctgtaggcggtcttgtaagtcagtggtgaaagcccatcgctcaacggtggaacggccattgatactgctggacttgaattattgggaagcaactagaatatgtagtgtagcggtgaaatgcttagagattacatggaataccaattgcgaaggcaggttgctaccaatggattgacgctgatggacgaaagcgtgggtagcgaacagg

SEQ ID NO: 70 - DNA, 254 bp, Unknown
  Kingdom: Bacteria, Phylum: Bacteroidetes, Class: Sphingobacteriia, Order: Sphingobacteriales, Family: Sphingobacteriaceae, Genus: Pedobacter
atacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacagg

SEQ ID NO: 71 - DNA, 254 bp, Unknown
  Kingdom: Bacteria, Phylum: Bacteroidetes, Class: Sphingobacteriia, Order: Sphingobacteriales, Family: Sphingobacteriaceae, Genus: Sphingobacterium
atacggaggatccgagcgttatccggatttattgggtttaaagggtgcgtaggcggccagttaagtcaggggtgaaatacggtggctcaaccatcgcagtgcctttgatactgacgggcttgaatccatttgaagtgggcggaataagacaagtagcggtgaaatgcatagatatgtcttagaactccgattgcgaaggcagctcactaagctggtattgacgctgatgcacgaaagcgtggggatcgaacagg

SEQ ID NO: 72 - DNA, 254 bp, Unknown
  Kingdom: Bacteria, Phylum: Bacteroidetes, Class: Sphingobacteriia, Order: Sphingobacteriales, Family: Sphingobacteriaceae, Genus: Sphingobacterium
atacggaggatccgagcgttatccggatttattgggtttaaagggtgcgtaggcggcctattaagtcaggggtgaaatacggtggctcaaccatcgcagtgcctttgatactgatgggcttgaatccatttgaagtgggcggaataagacaagtagcggtgaaatgcatagatatgtcttagaactccgattgcgaaggcagctcactaagctggtattgacgctgatgcacgaaagcgtggggatcgaacagg

SEQ ID NO: 73 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingobium
atacggagggagctagcgttgttcggaattactgggcgtaaagcgcacgtaggcggcgatttaagtcagaggtgaaagcccggggctcaaccccggaactgcctttgagactggattgcttgaatcctggagaggtgagtggaattccgagtgtagaggtgaaattcgtagatattcggaagaacaccagtggcgaaggcggctcactggacaggtattgacgctgaggtgcgaaagcgtggggagcaaacagg

SEQ ID NO: 74 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgtacgtaggcggctttgtaagttagaggtgaaagcccggggctcaaccccggaattgcctttaagactgcatcgcttgaacgtcggagaggtgagtggaattccgagtgtagaggtgaaattcgtagatattcggaagaacaccagtggcgaaggcggctcactggacgactgttgacgctgaggtacgaaagcgtggggagcaaacagg

SEQ ID NO: 75 - DNA, 254 bp, Unknown
  Kingdom: Bacteria, Phylum: Proteobacteria, Class: Gammaproteobacteria, Order: Enterobacteriales, Family: Enterobacteriaceae
atacggagggtgcaagcgttaatcggaattactgggcgtaaagcgcacgcaggcggtctgtcaagtcggatgtgaaatccccgggctcaacctgggaactgcattcgaaactggcagactagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 76 - DNA, 254 bp, Unknown
  Kingdom: Bacteria, Phylum: Proteobacteria, Class: Gammaproteobacteria, Order: Enterobacteriales, Family: Enterobacteriaceae, Genus: Pantoea
atacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 77 - DNA, 254 bp, Unknown
  Kingdom: Bacteria, Phylum: Proteobacteria, Class: Gammaproteobacteria, Order: Enterobacteriales, Family: Enterobacteriaceae
atacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 78 - DNA, 254 bp, Unknown
  Kingdom: Bacteria, Phylum: Proteobacteria, Class: Gammaproteobacteria, Order: Enterobacteriales, Family: Enterobacteriaceae, Genus: Escherichia/Shigella
atacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 79 - DNA, 254 bp, Unknown
  Kingdom: Bacteria, Phylum: Bacteroidetes, Class: Flavobacteriia, Order: Flavobacteriales, Family: Flavobacteriaceae, Genus: Chryseobacterium
atacggagggtgcaagcgttatccggatttattgggtttaaagggtccgtaggcggatccgtaagtcagtggtgaaatctcatagcttaactatgaaactgccattgatactgcgggtcttgagtaaggtagaagtagctggaataagtagtgtagcggtgaaatgcatagatattacttagaacaccaattgcgaaggcaggttactatgtcttaactgacgctgatggacgaaagcgtggggagcgaacagg

SEQ ID NO: 80 - DNA, 254 bp, Unknown
  Kingdom: Bacteria, Phylum: Proteobacteria, Class: Gammaproteobacteria, Order: Legionellales, Family: Legionellaceae, Genus: Legionella
atacggagggtgcgagcgttaatcggaattactgggcgtaaagggtgcgtaggtggttgattaagttatctgtgaaatccctgggctcaacctgggcaggtcagataatactggttaactcgagtatgggagagggtagtggaatttccggtgtagcggtgaaatgcgtagagatcggaaggaacaccagtggcgaaggcggctacctggcctaatactgacactgaggcacgaaagcgtggggagcaaacagg

SEQ ID NO: 81 - DNA, 254 bp, Unknown
  Kingdom: Bacteria, Phylum: Chloroflexi, Class: Ktedonobacteria, Order: C0119
atacgtaggaggcgagcgttgtccggatttactgggcgtaaagcgcgcgcaggcggcacttcaagtaaggtgtgaaatctccctgctcaacggggagggtgcactttagactgaggagctagaggacggtagaggggggtggaattgctggtgtagcggtgaaatgcgtagagatcagcaggaacacccgtggcgaaggcggccccctgggccgtacctgacgctgaggcgcgaaggctaggggagcgaacggg

SEQ ID NO: 82 - DNA, 255 bp, Unknown
  Kingdom: Bacteria, Phylum: Acidobacteria, Class: Acidobacteria, Order: Subgroup_4, Family: Unknown_Family, Genus: Blastocatella
  misc_feature (171)..(171): n is a, c, g, or t
atacgtagggagcaagcgttgttcggatttactgggcgtaaagggcgcgtaggcggcaaattaagtcatctgtgaaatctccgagcttaactcggaactgtcaggtgatactgatctgctagagtgcggaaggggcaatcggaattcttggtgtagcggtgaaatgcgtanatatcaagaggaacacctgaggtgaagacgggttgctgggccgacactgacgctgacagcgcgaaagccaggggagcaaacggg

SEQ ID NO: 83 - DNA, 254 bp, Unknown
  Kingdom: Bacteria, Phylum: Firmicutes, Class: Bacilli, Order: Bacillales, Family: Paenibacillaceae 2, Genus: Ammoniphilus
atacgtagggggcaagcgttgtccggaattattgggcgtaaagcgcgcgcaggcggcttattaagtctgatgtgaaagcccacggctcaaccgtggagggccattggaaactggtaggcttgagtgcaggagaggagagcggaattcccggtgtagcggtgaaatgcgtagatatcgggaggaacacccgtggcgaaggcggctctctggcctgtaactgacgctgaggcgcgaaagcgtggggagcaaacagg

SEQ ID NO: 84 - DNA, 253 bp, Unknown
  Kingdom: Bacteria, Phylum: Firmicutes, Class: Bacilli, Order: Bacillales, Family: Paenibacillaceae, Genus: Paenibacillus
atacgtagggggcaagcgttgtccggaattattgggcgtaaagcgcgcgcaggcggctttgtaagtctgtcgtttaagttcggggctcaaccccgtatcgcgatggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 85 - DNA, 254 bp, Unknown
  Kingdom: Bacteria, Phylum: Proteobacteria, Class: Betaproteobacteria, Order: Burkholderiales, Family: Burkholderiaceae, Genus: Ralstonia
atacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 86 - DNA, 254 bp, Unknown
  Kingdom: Bacteria, Phylum: Proteobacteria, Class: Betaproteobacteria, Order: Burkholderiales, Family: Burkholderiaceae, Genus: Ralstonia
atacgtagggtccaagcgttaatcggaattactgggcgtaaagcgtgcgcaggcggttgtgcaagaccgatgtgaaatccccgggcttaacctgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 87 - DNA, 254 bp, Unknown
  Kingdom: Bacteria, Phylum: Proteobacteria, Class: Betaproteobacteria, Order: Burkholderiales, Family: Comamonadaceae
atacgtagggtgcaagcgttaatcggaattactgggcgtaaagcgtgcgcaggcggtaatgtaagacagatgtgaaatccccgggctcaacctgggaactgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 88 - DNA, 254 bp, Unknown
  Kingdom: Bacteria, Phylum: Proteobacteria, Class: Betaproteobacteria, Order: Burkholderiales, Family: Comamonadaceae
atacgtagggtgcaagcgttaatcggaattactgggcgtaaagcgtgcgcaggcggttatgcaagacagaggtgaaatccccgggctcaacctgggaactgcctttgtgactgcatagctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 89 - DNA, 254 bp, Unknown
  Kingdom: Bacteria, Phylum: Proteobacteria, Class: Betaproteobacteria, Order: Burkholderiales, Family: Comamonadaceae, Genus: Pelomonas
atacgtagggtgcaagcgttaatcggaattactgggcgtaaagcgtgcgcaggcggttatgcaagacagaggtgaaatccccgggctcaacctgggaactgcctttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 90 - DNA, 254 bp, Unknown
  Kingdom: Bacteria, Phylum: Proteobacteria, Class: Betaproteobacteria, Order: Burkholderiales, Family: Oxalobacteraceae
atacgtagggtgcaagcgttaatcggaattactgggcgtaaagcgtgcgcaggcggttgtgcaagacagatgtgaaatccccgggcttaacctgggaattgcatttgtgactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacagg

SEQ ID NO: 91 - DNA, 254 bp, Unknown
  Kingdom: Bacteria, Phylum: Proteobacteria, Class: Betaproteobacteria, Order: Burkholderiales, Family: Oxalobacteraceae, Genus: Duganella
atacgtagggtgcaagcgttaatcggaattactgggcgtaaagcgtgcgcaggcggtttcgtaagtctgtcgtgaaatccccgggcttaacctgggaatggcgatggagactgcgaggctagagtttggcagaggggggtagaattccacgtgtagcagtgaaatgcgtagagatgtggaggaacaccgatggcgaaggcagccccctgggtcaaaactgacgctcatgcacgaaagcgtggggagcaaacagg

SEQ ID NO: 92 - DNA, 254 bp, Unknown
  Kingdom: Bacteria, Phylum: Proteobacteria, Class: Betaproteobacteria, Order: Burkholderiales, Family: Oxalobacteraceae, Genus: Duganella
atacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 93 - DNA, 254 bp, Unknown
  Kingdom: Bacteria, Phylum: Proteobacteria, Class: Betaproteobacteria, Order: Burkholderiales, Family: Comamonadaceae
atacgtagggtgcgagcgttaatcggaattactgggcgtaaagcgtgcgcaggcggtgatgtaagacagatgtgaaatccccgggctcaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 94 - DNA, 254 bp, Unknown
  Kingdom: Bacteria, Phylum: Proteobacteria, Class: Betaproteobacteria, Order: Burkholderiales, Family: Burkholderiaceae, Genus: Burkholderia
atacgtagggtgcgagcgttaatcggaattactgggcgtaaagcgtgcgcaggcggtttgctaagaccgatgtgaaatccccgggcttaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 95 - DNA, 254 bp, Unknown
  Kingdom: Bacteria, Phylum: Proteobacteria, Class: Betaproteobacteria, Order: Burkholderiales
atacgtagggtgcgagcgttaatcggaattactgggcgtaaagcgtgcgcaggcggttttgtaagacagaggtgaaatccccgggctcaacctgggaactgcctttgtgactgcaaggcttgagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 96 - DNA, 254 bp, Unknown
  Kingdom: Bacteria, Phylum: Proteobacteria, Class: Betaproteobacteria, Order: Nitrosomonadales, Family: Nitrosomonadaceae
atacgtagggtgcgagcgttaatcggaattactgggcgtaaagcgtgcgcaggcggttttgtaagccagatgtgaaatccccgggctcaacctgggaatggcatttgggactgcaaggcttgagtgcggcagaggagactggaattcctggtgtagcagtgaaatgcgtagatatcaggaggaataccgatggcgaaggcaggtctctgggctgacactgacgctcatgcacgaaagcgtggggagcaaacagg

SEQ ID NO: 97 - DNA, 254 bp, Unknown
  Kingdom: Bacteria, Phylum: Proteobacteria, Class: Betaproteobacteria
atacgtagggtgcgagcgttaatcggaattactgggcgtaaagcgtgcgcaggcggttttgtaagtcagatgtgaaatccccgggctcaacctgggaactgcgtttgaaactacaaggctagagtgtagaagaggggggtagaattccacgtgtagcagtgaaatgcgtagagatgtggaggaataccgatggcgaaggcagccccctgggctaacactgacgctcatgcacgaaagcgtggggagcaaacagg

SEQ ID NO: 98 - DNA, 254 bp, Unknown
  Kingdom: Bacteria, Phylum: Proteobacteria, Class: Betaproteobacteria, Order: Burkholderiales, Family: Oxalobacteraceae, Genus: Massilia
atacgtagggtgcgagcgttaatcggaattactgggcgtaaagcgtgcgcaggcggttttgtaagtctgacgtgaaatccccgggcttaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 99 - DNA, 254 bp, Unknown
  Kingdom: Bacteria, Phylum: Firmicutes, Class: Bacilli, Order: Bacillales
atacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacagg

SEQ ID NO: 100 - DNA, 254 bp, Unknown
  Kingdom: Bacteria, Phylum: Firmicutes, Class: Bacilli, Order: Bacillales, Family: Bacillaceae, Genus: Bacillus
atacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacagg

SEQ ID NO: 101 - DNA, 254 bp, Unknown
  Kingdom: Bacteria, Phylum: Firmicutes, Class: Bacilli, Order: Bacillales, Family: Alicyclobacillaceae, Genus: Tumebacillus
atacgtaggtggcgagcgttgtccggaatcactgggcgtaaagcgcgcgcaggcggcgatctacgtctggggtgaaagcccggagctcaactccgggactgccttggatacgggatcgcttgaggatcggagaggcaaggggaattccacgtgtagcggtgaaatgcgtagagatgtggaggaacacctgtggcgaaggcgccttgctggccgatttctgacgctgaggcgcgaaagcgtggggagcaaacagg

SEQ ID NO: 102 - DNA, 254 bp, Unknown
  Kingdom: Bacteria, Phylum: Chloroflexi, Class: TK10
atacgtaggtgtcgagcgttgtccggatttattgggcgtaaagcgcccgcaggcggcttgccaagttcgaagtgaaatctcccggcttaactgggagggtgctccgaaaactggcaggcttgagtcatggagagggatgtggaattcccggtgtagtggtgaaatgcgtagatatcgggaggaacaccagtggcgaaggcggcatcctggccatgtactgacgctcaggggcgaaagcgtggggagcaaaccgg

SEQ ID NO: 103 - DNA, 253 bp, Unknown
  Kingdom: Bacteria, Phylum: Proteobacteria, Class: Deltaproteobacteria, Order: Myxococcales
gacagagggtgcaaacgttgttcggaattactgggcgtaaagcgcgtgtaggcggctcggaaagtcggatgtgaaagccctgggcttaacctaggaagtgcattcgaaactcccgagcttgagttctggagagggaagcggaattctcggtgtagaggtgaaattcgtagatatcgagaggaacaccggtggcgaaggcggcttcctggacagtgactgacgctgagacgcgaaagcgtggggagcaaacagg

SEQ ID NO: 104 - DNA, 240 bp, Unknown
  Kingdom: Bacteria, Phylum: Cyanobacteria/Chloroplast, Class: Cyanobacteria
tacggaggaggcaagcgttatccggaatcattgggcgtaaagagtccgtaggtggctaaaaaagtctgctgtcaaagccttgggctaaaccgaagagaggcagtggaaactagggagctagagtgcggtaggggtagagggaattcccggtgtagcggtgaaatgcgtagagatcgggaagaacaccagtggcgaaagcgctctactgggcctgcactgacactgagggacgaaagctag

SEQ ID NO: 105 - DNA, 251 bp, Unknown
  Kingdom: Bacteria, Phylum: Armatimonadetes, Class: Chthonomonadetes, Order: Chthonomonadales, Family: Chthonomonadaceae, Genus: Chthonomonas/Armatimonadetes_gp3
tacggagggggcgagcgttgtccgaagttactgggcgtaaagcgcgtgtaggcgggttgccaagtccgctgtgaaagcccgaggctcaacctcggagggtcggtggatactggcagtcttgaagtggctagggggagatggaattaccggtgtagcggtgaaatgcgtagagatcggtaggaacaccagtggcgaaggcggtctcctggggctcttgacgctgagacgcgaaagctgggggagcgaacggg

SEQ ID NO: 106 - DNA, 251 bp, Unknown
  Kingdom: Bacteria, Phylum: Bacteroidetes, Class: Cytophagia, Order: Cytophagales, Family: Cytophagaceae, Genus: Fibrella
tacggagggtgcaagcgttgtccggatttattgggtttaaagggtgcgtaggtggccttttaagtcagctttgaaagctggtcgcttaacgatcaggggtgggttgatactggaaggcttggatcaggtggcggtttctggaacgggtcgtgtagcggtgaaatgcatagatatgacccagaactccgattgcgaaggcaggaggctacgcctattgacactgaggcacgagagcatggggagcaaacagg

SEQ ID NO: 107 - DNA, 251 bp, Unknown
  Kingdom: Bacteria, Phylum: Aerophobetes
tacgtaaggggcaagcgttgtccggaatcactgggcgtaaagcgcacgtaggcggtttagcaagtcaggggtgttagctctaggcttaacctagaaattgcctctgaaactacttcacttgagtattagaggggaagctggaattcacggtgtagcggtgaaatgcgtagatatcgtggagaacacccgtggcgaaggcgggcttctggctaaactgacgctgaggtgcgaaagctaggggagcgaacggg

SEQ ID NO: 108 - DNA, 251 bp, Unknown
  Kingdom: Bacteria, Phylum: Chloroflexi, Class: TK10
tacgtagggggcaagcgttgtccggatttattgggcgtaaaaggcttgtaggtggcccgctaagtcggatgtgaaatctcccggctcaactgggaggggtcattcgatactggcgggctcgaggccggtagggggaagtggaattcccggtgtagtggtggaatgcgtagatatcgggaggaacaccagtggcgaaggcggcttcctggaccgtctgacactgaggagcgaaagcgtggggagcgatccgg

SEQ ID NO: 109 - DNA, 253 bp, Unknown
  Kingdom: Bacteria, Phylum: Proteobacteria, Class: Betaproteobacteria
tacgtagggtgcaagcgttaatcggaatgactgggcgtaaagggtgcgcaggcggcctgttaagacagaggtgaaatccccgggcttaacctgggaatggcctatgtgactgtcaggctagaggatggcagagggaggcggaattccacgtgtagcagtgaaatgcgtagagatgtggaggaacaccgatggcgaaggcagcctcctgggccaattctgacgctcaggcacgaaagcgtggggatcaaacagg

SEQ ID NO: 110 - DNA, 240 bp, Unknown
  Kingdom: Bacteria, Phylum: Proteobacteria, Class: Betaproteobacteria
tacgtagggtgcaagcgttaatcggaatgactgggcgtaaagggtgcgcaggcggtttgctaagatagaggtgaaatccctgggctcaacctgggaatggcctatatgactggcaggctcgagtatggcagagggaggtggaattccacgtgtagcagtgaaatgcgtagagatgtggaggaacaccgatggcgaaggcagcctcctgggccaatactgacgctcaggcacgaaagcgtg

SEQ ID NO: 111 - DNA, 253 bp, Unknown
  Kingdom: Bacteria, Phylum: Proteobacteria, Class: Betaproteobacteria
tacgtagggtgcaagcgttaatcggaatgactgggcgtaaagggtgcgcaggcggtttgttaagacggatgtgaaagccccgggcttaacctgggaatagcatacgtgactagcaaactagaatatggcagagggaggtggaattccatgtgtagcagtgaaatgcgtagagatgtggaggaacaccgatggcgaaggcagcctcctgggccaatattgacgctcaggcacgaaagcgtggggagcaaacagg

SEQ ID NO: 112 - DNA, 240 bp, Unknown
  Kingdom: Bacteria, Phylum: Proteobacteria, Class: Betaproteobacteria, Order: Burkholderiales
tacgtagggtgcgagcgttaatcggaatgactgggcgtaaagggtgcgcaggcggttatgtaagatataggtgaaatccccgggcttaacctgggaatggcctgtgtgactgcatagctagagtgtgtcagagggaggtagaattccacgtgtagcagtgaaatgcgtagagatgtggaggaataccgatggcgaaggcagcctcctgggataacactgacgctcaggcacgaaagcgtg

SEQ ID NO: 113 - DNA, 253 bp, Unknown
  Kingdom: Bacteria, Phylum: Proteobacteria, Class: Betaproteobacteria
tacgtagggtgcgagcgttaatcggaatgactgggcgtaaagggtgcgcaggcggtttgcgaagatggatgtgaaaaccctgggcttaacctgggaatggcatacatgactcgcagactagaatatagcagagggaggtggaattccatgtgtagcagtgaaatgcgtagagatatggaggaacaccgatggcgaaggcagcctcctgggctaatattgacgctcaggcacgaaagcgtggggagcaaacagg

SEQ ID NO: 114 - DNA, 254 bp, Azotobacter chroococcum
atacgaagggtgcaagcgttaatcggaattactgggcgtaaagcgcgcgtaggtggttgggtaagttgaatgtgaaagccccgggctcaacctgggaactgcatccaaaactgcccgactagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 115 - DNA, 254 bp, Burkholderia soli
atacgtagggtgcgagcgttaatcggaattactgggcgtaaagcgtgcgcaggcggtttgctaagaccgatgtgaaatccccgggcttaacctgggaactgcattggtgactggcaggctagagtgtggcagaggggggtagaattccacgtgtagcagtgaaatgcgtagagatgtggaggaataccgatggcgaaggcagccccctgggctaacactgacgctcatgcacgaaagcgtggggagcaaacagg

SEQ ID NO: 116 - DNA, 251 bp, Clostridium acidisoli
tacgtaggtggcaagcgttgtccggaattactgggcgtaaaggatgtgtaggcggatatttaagtgagatgtgaaatccccgagctcaacttgggggctgcatttcaaactgggtatctagagtgcaggagaggaaagcggaattcctagtgtagccgtgaaatgcgtagagattaggaagaacatcagtgccgaaggcggctttctggactgactgacgctgaggcatgaaagcgtggggagcaaacagg

SEQ ID NO: 117 - DNA, 254 bp, Herpetosiphon aurantiacus
atacgtaggggccaagcgttgtccggaattactgggcgtaaagcgtgggtaggtggtcgatgatgtgccgcgtgaaagcgccggagtaatgccggcgaggtcgcggtagacacgttgactagaggctcgcagaggaacgtggaattcccggtgtagtggtgaaatgcgtagatatcgggaggaacaccagtggcgcaagcggcgttctgggcgagacctgacactgagccacgacggcgtggggagcaaacagg

SEQ ID NO: 118 - DNA, 254 bp, Microvirgula aerodenitrificans
atacgtagggtgcaagcgttaatcggaattactgggcgtaaagcgtgcgcaggcggtgagataagtcagctgtgaaagccccgggctcaacctgggaactgcggccgaaactgtctcgctagagtacgtcagaggggggtggaattccacgtgtagcagtgaaatgcgtagagatgtggaggaacaccaatggcgaaggcagccccctgggatgatactgacgctcatgcacgaaagcgtggggagcaaacagg

SEQ ID NO: 119 - DNA, 254 bp, Mucilaginibacter composti
atacggaggatccaagcgttatccggatttattgggtttaaagggtgcgtaggtggtttattaagtcaggggtgaaagacggcagcttaactgtcgcagtgcctttgatactgatgaacttgaatgaactagaggtaggcggaatgtgacaagtagcggtgaaatgcatagatatgtcacagaacaccaattgcgaaggcagcttactatggtttgattgacactgaggcacgaaagcgtggggatcaaacagg

SEQ ID NO: 120 - DNA, 251 bp, Pedobacter tournemirensis
tacggaggatccaagcgttatccggatttattgggtttaaagggtgcgtaggcggcttattaagtcaggggtgaaagacggtggctcaaccatcgcagtgcctttgatactgatgagcttgaatctacctgaggtaggcggaatgtgacaagtagcggtgaaatgcatagatatgtcacagaacaccaattgcgaaggcagcttactaaagtgattgacgctgaggcacgaaagcgtggggatcaaacagg

SEQ ID NO: 121 - DNA, 254 bp, Sphingomonas polyaromaticivorans
atacggagggggctagcgttgttcggaattactgggcgtaaagcgcacgtaggcggcttggtaagttagaggtgaaagcctggagctcaactccagaattgcctttaagactgccgagctagcaggtgagagaggtgagtggaattccgagtgtagaggtgaaattcgtagatattcggaagaacaccagtggcgaaggcggctcactggctcatactggacgctgaggtgcgaaagcgtggggagcaaacagg

SEQ ID NO: 122 - DNA, 251 bp, Thermomonas haemolytica
tacgaagggtgcaagcgttactcggaattactgggcgtaaagcgtgcgtaggtggttcgttaagtccgatgtgaaagccctgggctcaacctgggaatggcattggatactggcgggctagagtgcggtagaggatagtggaattcctggtgtagcagtgaaatgcgtagagatcaggaggaacatccgtggcgaaggcgactgtctggaccaactgacactgaggcacgaaagcgtggggagcaaacagg

SEQ ID NO: 123 - DNA, 254 bp, Verrucomicrobium spinosum
atacagaggtctcaagcgttgttcggaatcactgggcgtaaagggtgcgtaggtggcgtggaaagtcagatgtgaaatccgggggctcaacctccgaatagcatccgatactcccatgctagagaactggagggggatctggaattctcggtgtagcagtgaaatgcgtagatatcgagaggaacactagtggcgaaggcgagatcctggacagtatctgacactgatgcacgaaggtcaggggagcaaacggg

SEQ ID NO: 124 - DNA, 255 bp, Unknown
  Kingdom: Bacteria, Phylum: Planctomycetes, Class: Planctomycetacia, Order: Planctomycetales, Family: Planctomycetaceae
agacgaaccgtgcgaacgttattcggaatcattgggcttaaagggcgcgtaggcggcgatataagttggaagtgaaatcccatcggctcaaccgtggaatagctcccagtactgtatcgctcgagggggataggggtctgcggaactaccggtggagcggtgaaatgtgttgatatcggtgggaacgccagtggcgaaagcggcagacttgacccttcctgacgctgaggcgcgaaagctaggggagcaaacggg

SEQ ID NO: 125 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacagagggtgcaagcgttaatcggaattactgggcgtaaagcgcgcgtaggtggttagttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 126 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 127 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 128 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacagg

SEQ ID NO: 129 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 130 - DNA, 254 bp, Unknown
  Kingdom: Bacteria, Phylum: Proteobacteria, Class: Alphaproteobacteria, Order: Caulobacterales, Family: Caulobacteraceae, Genus: Asticcacaulis
atacgaagggggctagcgttgctcggaattactgggcgtaaagggagcgtaggcgggttatcaagttggaggtgaaagcccagggctcaaccttggaattgccttcaaaactgataacctagaggatgatagaggtaagtggaactccgagtgtagaggtgaaattcgtagatattcggaagaacaccagtggcgaaggcgacttactggatcattactgacgctgaggctcgaaagcgtggggagcaaacagg

SEQ ID NO: 131 - DNA, 254 bp, Unknown
  Kingdom: Bacteria, Phylum: Proteobacteria, Class: Alphaproteobacteria, Order: Caulobacterales, Family: Caulobacteraceae, Genus: Asticcacaulis
atacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacagg

SEQ ID NO: 132 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctagcgttgttcggaattactgggcgtaaagcgcacgtaggcggatatttaagtcaggggtgaaatcccagagctcaactctggaactgcctttgatactgggtatctagagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 133 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacagg

SEQ ID NO: 134 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacagg

SEQ ID NO: 135 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctagcgttgttcggaattactgggcgtaaagcgcacgtaggcggatatttaagtcaggggtgaaatcccgcagctcaactgcggaactgcctttgatactgggtatcttgagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 136 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacgaagggtgcaagcgttaatcggaattactgggcgtaaagcgcgcgtaggtggttcgttaagttggatgtgaaagccccgggctcaacctgggaactgcatccaaaactggcgagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacagg

SEQ ID NO: 137 - DNA, 254 bp, Unknown
  Kingdom: Bacteria, Phylum: Proteobacteria, Class: Gammaproteobacteria, Order: Xanthomonadales, Family: Xanthomonadaceae, Genus: Pseudoxanthomonas
atacgaagggtgcaagcgttactcggaattactgggcgtaaagcgtgcgtaggtggtggtttaagtctgctgtgaaagccctgggctcaacctgggaattgcagtggatactggatcactagagtgtggtagagggatgcggaatttctggtgtagcagtgaaatgcgtagagatcagaaggaacatccgtggcgaaggcggcatcctgggccaacactgacactgaggcacgaaagcgtggggagcaaacagg

SEQ ID NO: 138 - DNA, 254 bp, Unknown
  Kingdom: Bacteria, Phylum: Proteobacteria, Class: Gammaproteobacteria, Order: Xanthomonadales, Family: Xanthomonadaceae, Genus: Xanthomonas
atacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacagg

SEQ ID NO: 139 - DNA, 254 bp, Unknown
  Kingdom: Bacteria, Phylum: Proteobacteria, Class: Gammaproteobacteria, Order: Xanthomonadales, Family: Xanthomonadaceae, Genus: Stenotrophomonas
atacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctacctggaccaacactgacactgaggcacgaaagcgtggggagcaaacagg

SEQ ID NO: 140 - DNA, 254 bp, Unknown
  Kingdom: Bacteria, Phylum: Bacteroidetes, Class: Flavobacteriia, Order: Flavobacteriales, Family: Flavobacteriaceae, Genus: Flavobacterium
atacggaggatccaagcgttatccggaatcattgggtttaaagggtccgtaggcggtccggtaagtcagtggtgaaagcccatcgctcaacggtggaacggccattgatactgctggacttgaattactgggaagcaactagaatatgtagtgtagcggtgaaatgcttagagattacatggaataccaattgcgaaggcaggttgctaccagtggattgacgctgatggacgaaagcgtgggtagcgaacagg

SEQ ID NO: 141 - DNA, 254 bp, Unknown
  Kingdom: Bacteria, Phylum: Bacteroidetes, Class: Flavobacteriia, Order: Flavobacteriales, Family: Flavobacteriaceae, Genus: Flavobacterium
atacggaggatccaagcgttatccggaatcattgggtttaaagggtccgtaggcggtctggtaagtcagtggtgaaagcccatcgctcaacggtggaacggccattgatactgccagacttgaattatcaggaagtaactagaatatgtagtgtagcggtgaaatgcttagagattacatggaataccaattgcgaaggcaggttactactgatggattgacgctgatggacgaaagcgtgggtagcgaacagg

SEQ ID NO: 142 - DNA, 254 bp, Unknown
  Kingdom: Bacteria, Phylum: Bacteroidetes, Class: Flavobacteriia, Order: Flavobacteriales, Family: Flavobacteriaceae, Genus: Flavobacterium
atacggaggatccaagcgttatccggaatcattgggtttaaagggtccgtaggcggtcttgtaagtcagtggtgaaagcccatcgctcaacggtggaacggccattgatactgctggacttgaattattaggaagtaactagaatatgtagtgtagcggtgaaatgcttagagattacatggaataccaattgcgaaggcaggttactactaattgattgacgctgatggacgaaagcgtgggtagcgaacagg

SEQ ID NO: 143 - DNA, 254 bp, Unknown
  Kingdom: Bacteria, Phylum: Bacteroidetes, Class: Flavobacteriia, Order: Flavobacteriales, Family: Flavobacteriaceae, Genus: Flavobacterium
atacggaggatccaagcgttatccggaatcattgggtttaaagggtccgtaggcggtttagtaagtcagtggtgaaagcccatcgctcaacggtggaacggccattgatactgctagacttgaattattaggaagtaactagaatatgtagtgtagcggtgaaatgcttagagattacatggaataccaattgcgaaggcaggttactactaatgtattgacgctgatggacgaaagcgtggggagcgaacagg

SEQ ID NO: 144 - DNA, 254 bp, Unknown
  Kingdom: Bacteria, Phylum: Bacteroidetes, Class: Sphingobacteriia, Order: Sphingobacteriales, Family: Sphingobacteriaceae, Genus: Mucilaginibacter
atacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 145 - DNA, 254 bp, Unknown
  Kingdom: Bacteria, Phylum: Proteobacteria, Class: Alphaproteobacteria, Order: Sphingomonadales, Family: Sphingomonadaceae, Genus: Novosphingobium
atacggagggagctagcgttgttcggaattactgggcgtaaagcgcacgtaggcggcgactcaagtcagaggtgaaagcccggggctcaaccccggaactgcctttgaaactaggttgctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 146 - DNA, 254 bp, Unknown
  Kingdom: Bacteria, Phylum: Proteobacteria, Class: Alphaproteobacteria, Order: Sphingomonadales, Family: Sphingomonadaceae, Genus: Novosphingobium
atacggagggagctagcgttgttcggaattactgggcgtaaagcgcacgtaggcggctactcaagtcagaggtgaaagcccggggctcaaccccggaactgcctttgaaactaggtagctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 147 - DNA, 254 bp, Unknown
  Kingdom: Bacteria, Phylum: Proteobacteria, Class: Alphaproteobacteria, Order: Sphingomonadales, Family: Sphingomonadaceae, Genus: Novosphingobium
atacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 148 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingobium
atacggagggggctagcgttgttcggaattactgggcgtaaagcgcacgtaggcggcgatttaagtcaggggtgaaagcccagtgctcaacactggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacagg

SEQ ID NO: 149 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingobium
atacggagggggctagcgttgttcggaattactgggcgtaaagcgcacgtaggcggcgatttaagtcaggggtgaaagcccagtgctcaacactggaactgcctttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacagg

SEQ ID NO: 150 - DNA, 254 bp, Unknown
  Kingdom: Bacteria, Phylum: Proteobacteria, Class: Gammaproteobacteria, Order: Enterobacterales, Family: Enterobacteriaceae, Genus: Enterobacter
atacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagcgtggggagcaaacagg

SEQ ID NO: 151 - DNA, 254 bp, Unknown
  Kingdom: Bacteria, Phylum: Proteobacteria, Class: Gammaproteobacteria, Order: Enterobacteriales, Family: Enterobacteriaceae
atacggagggtgcaagcgttaatcggaattactgggcgtaaagcgcacgcaggcggtctgtcaagtcggatgtgaaatccccgggctcaacctgggaactgcattcgaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 152 - DNA, 254 bp, Unknown
  Kingdom: Bacteria, Phylum: Proteobacteria, Class: Gammaproteobacteria, Order: Enterobacteriales, Family: Enterobacteriaceae
atacggagggtgcaagcgttaatcggaattactgggcgtaaagcgcacgcaggcggtctgtcaagtcggatgtgaaatccccgggctcaacctgggaactgcattcgaaactggcaggctagagtctcgtagagggaggtagaattccaggtgtagcggtgaaatgcgtagagatctggaggaataccggtggcgaaggcggcctcctggacgaagactgacgctcaggtgcgaaagcgtggggagcaaacagg

SEQ ID NO: 153 - DNA, 254 bp, Unknown
  Kingdom: Bacteria, Phylum: Proteobacteria, Class: Gammaproteobacteria, Order: Enterobacteriales, Family: Enterobacteriaceae
atacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 154 - DNA, 254 bp, Unknown
  Kingdom: Bacteria, Phylum: Proteobacteria, Class: Gammaproteobacteria, Order: Enterobacteriales, Family: Enterobacteriaceae, Genus: Salmonella
atacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 155 - DNA, 254 bp, Unknown
  Kingdom: Bacteria, Phylum: Proteobacteria, Class: Gammaproteobacteria, Order: Enterobacteriales, Family: Enterobacteriaceae, Genus: Yersinia
atacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 156 - DNA, 254 bp, Unknown
  Kingdom: Bacteria, Phylum: Proteobacteria, Class: Gammaproteobacteria, Order: Cellvibrionales, Family: Cellvibrionaceae, Genus: Cellvibrio
atacggagggtgcaagcgttaatcggaattactgggcgtaaagcgcacgtaggtggtttgctaagtcagctgtgaaatccccgggctcaacctgggcactgcagttgaaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 157 - DNA, 254 bp, Unknown
  Kingdom: Bacteria, Phylum: Proteobacteria, Class: Gammaproteobacteria, Order: Xanthomonadales, Family: Rhodanobacteraceae, Genus: Luteibacter
atacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacagg

SEQ ID NO: 158 - DNA, 254 bp, Unknown
  Kingdom: Bacteria, Phylum: Bacteroidetes, Class: Chitinophagia, Order: Chitinophagales, Family: Chitinophagaceae, Genus: Chitinophaga
atacggagggtgcaagcgttatccggattcactgggtttaaagggtgcgtaggcggatttgtaagtccgtggtgaaatctccaggcttaacctggaaactgccatggatactataaatcttgaatgttgtggaggttagcggaatatgtcatgtagcggtgaaatgcatagatatgacatagaacaccaattgcgaaggcagctggctacacaaatattgacgctgaggcacgaaagcgtggggatcaaacagg

SEQ ID NO: 159 - DNA, 254 bp, Unknown
  Kingdom: Bacteria, Phylum: Bacteroidetes, Class: Chitinophagia, Order: Chitinophagales, Family: Chitinophagaceae, Genus: Chitinophaga
atacggagggtgcaagcgttatccggattcactgggtttaaagggtgcgtaggcggatttgtaagtccgtggtgaaatctccaggcttaacctggaaactgccatggatactataagtcttgaatattgtggaggttagcggaatatgtcatgtagcggtgaaatgcatagatatgacatagaacaccaattgcgaaggcagctggctacacaaatattgacgctgaggcacgaaagcgtggggatcaaacagg

SEQ ID NO: 160 - DNA, 254 bp, Unknown
  Kingdom: Bacteria, Phylum: Bacteroidetes, Class: Flavobacteriia, Order: Flavobacteriales, Family: Flavobacteriaceae, Genus: Chryseobacterium
atacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacagg

SEQ ID NO: 161 - DNA, 254 bp, Unknown
  Kingdom: Bacteria, Phylum: Bacteroidetes, Class: Flavobacteriia, Order: Flavobacteriales, Family: Flavobacteriaceae, Genus: Chryseobacterium
atacggagggtgcaagcgttatccggatttattgggtttaaagggtccgtaggcggatctgtaagtcagtggtgaaatctcatagcttaactatgaaactgccattgatactgcaggtcttgagtaaagtagaagtggctggaataagtagtgtagcggtgaaatgcatagatattacttagaacaccaattgcgaaggcaggtcactatgttttaactgacgctgatggacgaaagcgtggggagcgaacagg

SEQ ID NO: 162 - DNA, 254 bp, Unknown
  Kingdom: Bacteria, Phylum: Bacteroidetes, Class: Flavobacteriia, Order: Flavobacteriales, Family: Flavobacteriaceae, Genus: Chryseobacterium
atacggagggtgcaagcgttatccggatttattgggtttaaagggtccgtaggcggatgtgtaagtcagtggtgaaatctcacagctcaactgtgaaactgccattgatactgcatgtcttgagtaaggtagaagtggctggaataagtagtgtagcggtgaaatgcatagatattacttagaacaccaattgcgaaggcaggtcactatgtcttaactgacgctgatggacgaaagcgtggggagcgaacagg

SEQ ID NO: 163 - DNA, 254 bp, Unknown
  Kingdom: Bacteria, Phylum: Bacteroidetes, Class: Flavobacteriia, Order: Flavobacteriales, Family: Flavobacteriaceae, Genus: Chryseobacterium
atacggagggtgcaagcgttatccggatttattgggtttaaagggtccgtaggcggatgtgtaagtcagtggtgaaatctcacagcttaactgtgaaactgccattgatactgcatgtcttgagtaaggtagaagtggctggaataagtagtgtagcggtgaaatgcatagatattacttagaacaccaattgcgaaggcaggtcactatgtcttaactgacgctgatggacgaaagcgtggggagcgaacagg

SEQ ID NO: 164 - DNA, 254 bp, Unknown
  Kingdom: Bacteria, Phylum: Bacteroidetes, Class: Flavobacteriia, Order: Flavobacteriales, Family: Flavobacteriaceae, Genus: Chryseobacterium
atacggagggtgcaagcgttatccggatttattgggtttaaagggtccgtaggcggatgtgtaagtcagtggtgaaatctcacagcttaactgtgaaactgccattgatactgcatgtcttgagtgttgttgaagtagctggaataagtagtgtagcggtgaaatgcatagatattacttagaacaccaattgcgaaggcaggttactaagcaacaactgacgctgatggacgaaagcgtggggagcgaacagg

SEQ ID NO: 165 - DNA, 254 bp, Unknown
  Kingdom: Bacteria, Phylum: Bacteroidetes, Class: Cytophagia, Order: Cytophagales, Family: Cytophagaceae, Genus: Dyadobacter
atacggagggtgcgagcgttgtccggatttattgggtttaaagggtgcgtaggtggctgtttaagtcagtggtgaaatacggttgctcaacaatcgaggtgccattgatactgaatagcttgaaataattggaggctgccggaatggatggtgtagcggtgaaatgcatagatatcatccagaacaccgattgcgaaggcaggtggctacgatttgtttgacactgaggcacgaaagcatggggagcaaacagg

SEQ ID NO: 166 - DNA, 254 bp, Unknown
  Kingdom: Bacteria, Phylum: Actinobacteria, Class: Actinobacteria, Order: Actinomycetales, Family: Micrococcaceae, Genus: Arthrobacter
atacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 167 - DNA, 254 bp, Unknown
  Kingdom: Bacteria, Phylum: Proteobacteria, Class: Betaproteobacteria, Order: Burkholderiales, Family: Comamonadaceae
atacgtagggtgcaagcgttaatcggaattactgggcgtaaagcgtgcgcaggcggtgatgtaagacagatgtgaaatccccgggctcaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 168 - DNA, 254 bp, Unknown
  Kingdom: Bacteria, Phylum: Proteobacteria, Class: Betaproteobacteria, Order: Burkholderiales, Family: Roseateles
atacgtagggtgcaagcgttaatcggaattactgggcgtaaagcgtgcgcaggcggttatgcaagacagatgtgaaatccccgggctcaacctgggaactgcatttgtgactgcatagctagagtacggtagagggggatggaattccacgtgtagcagtgaaatgcgtagatatgtggaggaacaccgatggcgaaggcaatcccctggacctgtactgacgctcatgcacgaaagcgtggggagcaaacagg

SEQ ID NO: 169 - DNA, 254 bp, Unknown
  Kingdom: Bacteria, Phylum: Proteobacteria, Class: Betaproteobacteria, Order: Burkholderiales, Family: Comamonadaceae, Genus: Acidovorax
atacgtagggtgcaagcgttaatcggaattactgggcgtaaagcgtgcgcaggcggttatgtaagacagatgtgaaatccccgggctcaacctgggaactgcatttgtgactgcatagctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 170 - DNA, 254 bp, Unknown
  Kingdom: Bacteria, Phylum: Proteobacteria, Class: Betaproteobacteria, Order: Burkholderiales, Family: Comamonadaceae
atacgtagggtgcaagcgttaatcggaattactgggcgtaaagcgtgcgcaggcggttatgtaagacagatgtgaaatccccgggctcaacctgggaactgcatttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 171 - DNA, 254 bp, Unknown
  Kingdom: Bacteria, Phylum: Proteobacteria, Class: Betaproteobacteria, Order: Burkholderiales, Family: Comamonadaceae
atacgtagggtgcaagcgttaatcggaattactgggcgtaaagcgtgcgcaggcggttatgtaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 172 - DNA, 254 bp, Unknown
  Kingdom: Bacteria, Phylum: Proteobacteria, Class: Betaproteobacteria, Order: Burkholderiales, Family: Burkholderiaceae, Genus: Burkholderia
atacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 173 - DNA, 254 bp, Unknown
  Kingdom: Bacteria, Phylum: Proteobacteria, Class: Betaproteobacteria, Order: Burkholderiales, Family: Alcaligenaceae
atacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacagg

SEQ ID NO: 174 - DNA, 254 bp, Unknown
  Kingdom: Bacteria, Phylum: Proteobacteria, Class: Betaproteobacteria, Order: Burkholderiales, Family: Burkholderiaceae, Genus: Burkholderia
atacgtagggtgcaagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 175 - DNA, 254 bp, Unknown
  Kingdom: Bacteria, Phylum: Proteobacteria, Class: Betaproteobacteria, Order: Burkholderiales, Family: Comamonadaceae, Genus: Comamonas
atacgtagggtgcaagcgttaatcggaattactgggcgtaaagcgtgcgcaggcggttttgtaagacagaggtgaaatccccgggctcaacctgggaactgcctttgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 176 - DNA, 254 bp, Unknown
  Kingdom: Bacteria, Phylum: Proteobacteria, Class: Betaproteobacteria, Order: Burkholderiales, Family: Comamonadaceae
atacgtagggtgcaagcgttaatcggaattactgggcgtaaagcgtgcgcaggcggttttgtaagacagaggtgaaatccccgggctcaacctgggaactgcctttgtgactgcaaggcttgagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 177 - DNA, 254 bp, Unknown
  Kingdom: Bacteria, Phylum: Proteobacteria, Class: Betaproteobacteria, Order: Burkholderiales, Family: Oxalobacteraceae, Genus: Duganella
atacgtagggtgcaagcgttaatcggaattactgggcgtaaagcgtgcgcaggcggttttgtaagactgacgtgaaatccccgggctcaacctgggaatggcgttggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 178 - DNA, 254 bp, Unknown
  Kingdom: Bacteria, Phylum: Proteobacteria, Class: Betaproteobacteria, Order: Burkholderiales, Family: Oxalobacteraceae, Genus: Massilia
atacgtagggtgcaagcgttaatcggaattactgggcgtaaagcgtgcgcaggcggttttgtaagtctgacgtgaaagccccgggcttaacctgggaattgcgttggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 179 - DNA, 254 bp, Unknown
  Kingdom: Bacteria, Phylum: Proteobacteria, Class: Betaproteobacteria, Order: Burkholderiales, Family: Oxalobacteraceae
atacgtagggtgcaagcgttaatcggaattactgggcgtaaagcgtgcgcaggcggttttgtaagtctgtcgtgaaagccccgggcttaacctgggaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 180 - DNA, 254 bp, Unknown
  Kingdom: Bacteria, Phylum: Proteobacteria, Class: Betaproteobacteria, Order: Burkholderiales, Family: Oxalobacteraceae
atacgtagggtgcaagcgttaatcggaattactgggcgtaaagcgtgcgcaggcggttttgtaagtctgtcgtgaaatccccgggcttaacctgggaatggcgatggagactgcaaggctagagtttggcagaggggggtagaattccacgtgtagcagtgaaatgcgtagagatgtggaggaacaccgatggcgaaggcagccccctgggtcaaaactgacgctcatgcacgaaagcgtggggagcaaacagg

SEQ ID NO: 181 - DNA, 254 bp, Unknown
  Kingdom: Bacteria, Phylum: Actinobacteria, Class: Actinobacteria, Order: Actinomycetales, Family: Microbacteriaceae
atacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 182 - DNA, 254 bp, Unknown
  Kingdom: Bacteria, Phylum: Proteobacteria, Class: Betaproteobacteria, Order: Burkholderiales, Family: Comamonadaceae
atacgtagggtgcgagcgttaatcggaattactgggcgtaaagcgtgcgcaggcggctttgcaagacagatgtgaaatccccgggctcaacctgggaactgcatttgtgactgcaaggctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 183 - DNA, 254 bp, Unknown
  Kingdom: Bacteria, Phylum: Proteobacteria, Class: Betaproteobacteria, Order: Burkholderiales, Family: Comamonadaceae, Genus: Simplicispira
atacgtagggtgcgagcgttaatcggaattactgggcgtaaagcgtgcgcaggcggttatataagacagatgtgaaatccccgggctcaacctgggaactgcattagtgactgtatagctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 184 - DNA, 254 bp, Unknown
  Kingdom: Bacteria, Phylum: Proteobacteria, Class: Betaproteobacteria, Order: Burkholderiales, Family: Comamonadaceae, Genus: Acidovorax
atacgtagggtgcgagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 185 - DNA, 254 bp, Unknown
  Kingdom: Bacteria, Phylum: Proteobacteria, Class: Betaproteobacteria, Order: Burkholderiales, Family: Burkholderiaceae, Genus: Burkholderia
atacgtagggtgcgagcgttaatcggaattactgggcgtaaagcgtgcgcaggcggttcgctaagaccgatgtgaaatccccgggcttaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 186 - DNA, 254 bp, Unknown
  Kingdom: Bacteria, Phylum: Proteobacteria, Class: Betaproteobacteria, Order: Burkholderiales
atacgtagggtgcgagcgttaatcggaattactgggcgtaaagcgtgcgcaggcggttgtgtaagacagatgtgaaatccccgggctcaacctgggaactgcatttgtgactgcacggcttgagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 187 - DNA, 254 bp, Unknown
  Kingdom: Bacteria, Phylum: Proteobacteria, Class: Betaproteobacteria, Order: Burkholderiales, Family: Burkholderiaceae, Genus: Burkholderia
atacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 188 - DNA, 254 bp, Unknown
  Kingdom: Bacteria, Phylum: Proteobacteria, Class: Betaproteobacteria, Order: Methylophilales, Family: Methylophilaceae, Genus: Methylophilus
atacgtagggtgcgagcgttaatcggaattactgggcgtaaagcgtgcgcaggcggtttggcaagtcagatgtgaaatccccgagctcaacttgggaactgcgtttgaaactgccagactagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 189 - DNA, 254 bp, Unknown
  Kingdom: Bacteria, Phylum: Proteobacteria, Class: Betaproteobacteria, Order: Methylophilales, Family: Methylophilaceae, Genus: Methylophilus
atacgtagggtgcgagcgttaatcggaattactgggcgtaaagcgtgcgcaggcggtttggtaagtcagatgtgaaatccccgagctcaacttgggaactgcgtttgaaactgtcagactagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 190 - DNA, 254 bp, Unknown
  Kingdom: Bacteria, Phylum: Proteobacteria, Class: Betaproteobacteria, Order: Burkholderiales, Family: Burkholderiaceae, Genus: Burkholderia
atacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 191 - DNA, 254 bp, Unknown
  Kingdom: Bacteria, Phylum: Proteobacteria, Class: Betaproteobacteria, Order: Burkholderiales, Family: Burkholderiaceae, Genus: Burkholderia
atacgtagggtgcgagcgttaatcggaattactgggcgtaaagcgtgcgcaggcggtttgttaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 192 - DNA, 254 bp, Unknown
  Kingdom: Bacteria, Phylum: Acidobacteria, Class: Acidobacteria_Gp16, Order: Gp16, Family: Gp16, Genus: Gp16
atacgtaggtggcaagcgttgtccggatttactgggcgtaaagagcgcgcaggcggtcgttcaagtcgcgtgtgaaagcccccggctcaactggggagggtcacgcgatactgatcgactcgaaggcaggagagggtagtggaattcccggtgtagtggtgaaatgcgtagatatcgggaggaacaccagtggcgaaggcgactacctggcctgttcttgacgctgaggcgcgaaagctaggggagcaaacggg

SEQ ID NO: 193 - DNA, 254 bp, Unknown
  Kingdom: Bacteria, Phylum: Firmicutes, Class: Clostridia, Order: Clostridiales, Family: Clostridiaceae, Genus: Clostridium
atacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 194 - DNA, 254 bp, Unknown
  Kingdom: Bacteria, Phylum: Firmicutes, Class: Clostridia, Order: Clostridiales, Family: Clostridiaceae, Genus: Clostridium
atacgtaggtggcaagcgttgtccggatttactgggcgtaaagggagcgtaggtggatatttaagtgggatgtgaaatactcgggcttaacttgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 195 - DNA, 251 bp, Unknown
  Kingdom: Bacteria, Phylum: Proteobacteria, Class: Gammaproteobacteria
tacagagggtgcaagcgttaatcggaattactgggcgtaaagggtgcgtaggtggatacgtaagtcagatgtgaaatccccgggcttaacctgggaactgcatatgatactgcgaatctagagtatggtagaggtaagtggaatttccggtgtagcggtgaaatgcgtagatatcggaaggaacatcagtggcgaaggcgacttactggactgactgacactgaggcacgaaagcgtggggagcaaacagg

SEQ ID NO: 196 - DNA, 251 bp, Unknown
  Kingdom: Bacteria, Phylum: Proteobacteria, Class: Betaproteobacteria, Order: Burkholderiales, Family: Oxalobacteraceae, Genus: Massilia
tacgtagggtgcaagcgttaatcggaattactgggcgtaaagcgtgcgcaggcggttttgtaagtctgtcgtgaaatccccgggcttaacctgggaatggcgatggagactgcaaggctggaatctggcagaggggggtagaattccacgtgtagcagtgaaatgcgtagagatgtggaggaacaccgatggcgaaggcagccccctgggctaattgacgctcatgcacgaaagcgtggggagcaaacagg

SEQ ID NO: 197 - DNA, 254 bp, Agrobacterium tumefaciens
atacgaagggggctagcgttgttcggaattactgggcgtaaagcgcacgtaggcggatatttaagtcaggggtgaaatcccggggctcaacctcggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 198 - DNA, 254 bp, Novosphingobium sediminicola
atacggagggagctagcgttgttcggaattactgggcgtaaagcgcacgtaggcggttactcaagtcagaggtgaaagcccggggctcaaccccggaactgcctttgaaactaggtaactagaatcctggagaggtgagtggaattccgagtgtagaggtgaaattcgtagatattcggaagaacaccagtggcgaaggcggctcactggacaggtattgacgctgaggtgcgaaagcgtggggagcaaacagg

SEQ ID NO: 199 - DNA, 254 bp, Unknown
  Kingdom: Bacteria, Phylum: Proteobacteria, Class: Alphaproteobacteria, Order: Caulobacterales, Family: Caulobacteraceae, Genus: Brevundimonas
atacgaagggggctagcgttgctcggaattactgggcgtaaagggagcgtaggcggacatttaagtcaggggtgaaatcccggggctcaacctcggaattgcctttgatactgggtgtcttgagtatgagagaggtgtgtggaactccgagtgtagaggtgaaattcgtagatattcggaagaacaccagtggcgaaggcgacacactggctcattactgacgctgaggctcgaaagcgtggggagcaaacagg

SEQ ID NO: 200 - DNA, 254 bp, Unknown
  Kingdom: Bacteria, Phylum: Proteobacteria, Class: Alphaproteobacteria, Order: Caulobacterales, Family: Caulobacteraceae, Genus: Phenylobacterium
atacgaagggggctagcgttgctcggaattactgggcgtaaagggcgcgtaggcggacagtttagtcagaggtgaaagcccagggctcaaccttggaattgcctttgatactggctgtcttgagttcgggagaggtgagtggaatgccgagtgtagaggtgaaattcgtagatattcggcggaacaccagtggcgaaggcgactcactggcccgatactgacgctgaggcgcgaaagcgtggggagcaaacagg

SEQ ID NO: 201 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctagcgttgttcggaattactgggcgtaaagcgcacgtaggcggacatttaagtcaggggtgaaatcccggggctcaacctcggaactgcctttgatactgggtgtcttgagtgtggaagaggtcagtggaattgcgagtgtagaggtgaaattcgtagatattcgcaggaacaccagtggcgaaggcggctgactggtccacaactgacgctgaggtgcgaaagcgtggggagcaaacagg

SEQ ID NO: 202 - DNA, 254 bp, Unknown
  Kingdom: Bacteria, Phylum: Proteobacteria, Class: Alphaproteobacteria, Order: Rhizobiales, Family: Rhizobiaceae, Genus: Rhizobium
atacgaagggggctagcgttgttcggaattactgggcgtaaagcgcacgtaggcggatatttaagtcaggggtgaaatcccgcagctcaactgcggaactgcctttgatactgggtatcttgagtatggaagaggttagtggaattgcgagtgtagaggtgaaattcgtagatattcgcaggaacaccagtggcgaaggcggctaactggtccataactgacgctgaggtgcgaaagcgtggggagcaaacagg

SEQ ID NO: 203 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggagctagcgttgttcggaattactgggcgtaaagcgcacgtaggcggctttgtaagttagaggtgaaagcctggagctcaactccagaactgcctttgatactgcatggcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 204 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacagg

SEQ ID NO: 205 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 206 - DNA, 22 bp, Unknown
  primer - ITS_1
cttggtcatttagaggaagtaa

SEQ ID NO: 207 - DNA, 17 bp, Unknown
  primer - LR5
tcctgagggaaacttcg

SEQ ID NO: 208 - DNA, 20 bp, Unknown
  primer - ITS_2
gctgcgttcttcatcgatgc

SEQ ID NO: 209 - DNA, 20 bp, Unknown
  primer - ITS_3
gcatcgatgaagaacgcagc

SEQ ID NO: 210 - DNA, 19 bp, Unknown
  primer - fITS7
gtgartcatcgaatctttg

SEQ ID NO: 211 - DNA, 20 bp, Unknown
  primer - ITS4
tcctccgcttattgatatgc

SEQ ID NO: 212 - DNA, 17 bp, Unknown
  primer - PGK
gtygayttcaaygtycc

SEQ ID NO: 213 - DNA, 20 bp, Unknown
  primer - PGK
acaccdggdggrccgttcca

SEQ ID NO: 214 - DNA, 19 bp, Unknown
  primer - ACT512f
atgtgcaaggccggtttcg

SEQ ID NO: 215 - DNA, 20 bp, Unknown
  primer - ACT783r
tacgagtccttctggcccat

SEQ ID NO: 216 - DNA, 28 bp, Unknown
  primer - fusA-f2
tcgcgttcgttaacaaaatggaccgtat

SEQ ID NO: 217 - DNA, 28 bp, Unknown
  primer - fusA-R2
tcgccagacggcccagagccagacccat

SEQ ID NO: 218 - DNA, 20 bp, Unknown
  primer - RPB1-Af
gartgyccdggdcayttygg

SEQ ID NO: 219 - DNA, 23 bp, Unknown
  primer - RPB1-Cr
  misc_feature (3)..(3): n is a, c, g, or t
  misc_feature (9)..(9): n is a, c, g, or t
ccngcdatntcrttrtccatrta

SEQ ID NO: 220 - DNA, 17 bp, Unknown
  primer - LR0R
acccgctgaacttaagc

SEQ ID NO: 221 - DNA, 23 bp, Unknown
  primer - bRPB2-7.1R
cccatrgcytgyttmcccatdgc

SEQ ID NO: 222 - DNA, 20 bp, Unknown
  primer - fRPB2-5F
gaygaymgwgatcayttygg

SEQ ID NO: 223 - DNA, 19 bp, Unknown
  primer - NS1
gtagtcatatgcttgtctc

SEQ ID NO: 224 - DNA, 20 bp, Unknown
  primer - NS4
cttccgtcaattcctttaag

SEQ ID NO: 225 - DNA, 21 bp, Unknown
  primer - SR1R
tacctggttgattctgccagt

SEQ ID NO: 226 - DNA, 23 bp, Unknown
  primer - Btub2Fd
gtbcacctycaraccggycartg

SEQ ID NO: 227 - DNA, 26 bp, Unknown
  primer - Btub4Rd
ccrgaytgrccraaracraagttgtc

SEQ ID NO: 228 - DNA, 1410 bp, Unknown
  Kingdom: Bacteria, Phylum: Proteobacteria, Class: Gammaproteobacteria, Order: Enterobacterales, Family: Enterobacteriaceae, Genus: Enterobacter
atgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctacca

SEQ ID NO: 229 - DNA, 1402 bp, Unknown
  Kingdom: Bacteria, Phylum: Proteobacteria, Class: Gammaproteobacteria, Order: Enterobacteriales, Family: Enterobacteriaceae, Genus: Enterobacter
cggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 230 - DNA, 1410 bp, Lelliottia amnigena
catgcagtcgagcggtagcacagggagcttgctcctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcacaaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctacc

SEQ ID NO: 231 - DNA, 254 bp, Unknown; identical to SEQ ID NO: 153
  Kingdom: Bacteria, Phylum: Proteobacteria, Class: Gammaproteobacteria, Order: Enterobacteriales, Family: Enterobacteriaceae

SEQ ID NO: 232 - DNA, 952 bp, Acinetobacter calcoaceticus
catgcagtcgagcggagagaggtagcttgctactgatcttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcgcaagcctgatccagccatgccgcgtgtgtgaagaaggccttatggttgtaaagcactttaagcgaggaggaggctactttagataatacctagagatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttcc

SEQ ID NO: 233 - DNA, 1345 bp, Unknown
  Kingdom: Bacteria, Phylum: Proteobacteria, Class: Gammaproteobacteria, Order: Pseudomonadales, Family: Moraxellaceae, Genus: Acinetobacter
atgcagtcgagcggggtgatggtgcttgcactatcacttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttatggttgtaaagcactttaagcgaggaggaggctactctagttaatacctagggatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgccc

SEQ ID NO: 234 - DNA, 1402 bp, Unknown
  Kingdom: Bacteria, Phylum: Proteobacteria, Class: Gammaproteobacteria, Order: Pseudomonadales, Family: Moraxellaceae, Genus: Acinetobacter
catgcaagtcgagcggggtgatggtgcttgcactatcacttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttatggttgtaaagcactttaagcgaggaggaggctactctagttaatacctagggatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcacaccatgggagtttgttgcaccagaagtagctagcctaactgcaaagaggg

SEQ ID NO: 235 - DNA, 254 bp, Unknown
  Kingdom: Bacteria, Phylum: Proteobacteria, Class: Gammaproteobacteria, Order: Pseudomonadales, Family: Moraxellaceae, Genus: Acinetobacter
atacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacagg

SEQ ID NO: 236 - DNA, 1377 bp, Arthrobacter pascens
acgatgatctccagcttgctggggggattagtggcgaacgggtgagtaacacgtgagtaacctgcccttaactctgggataagcctgggaaactgggtctaataccggatatgactcctcatcgcatggtggggggtggaaagctttttgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgccgcagaaatgtggtttcccctttggggccggttcacaggtggtgcatggttgtcgtcagctcgtgtcgtgagatgttgggttaagtcccgcaacgagcgcaaccctcgttctatgttgccagcgcgtgatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagg

SEQ ID NO: 237 - DNA, 1325 bp, Unknown
  Kingdom: Bacteria, Phylum: Actinobacteria, Class: Actinobacteria, Order: Actinomycetales, Family: Micrococcaceae, Genus: Arthrobacter
gtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaacacctggaaacaggtgccccgcttgcggtcggtttacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagg

SEQ ID NO: 238 - DNA, 1267 bp, Unknown
  Kingdom: Bacteria, Phylum: Actinobacteria, Class: Actinobacteria, Order: Actinomycetales, Family: Micrococcaceae, Genus: Arthrobacter
actgatcatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatggttggcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaagacctggaaacaggtcccccacttgtggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 239 - DNA, 1383 bp, Unknown
  Kingdom: Bacteria, Phylum: Actinobacteria, Class: Actinobacteria, Order: Actinomycetales, Family: Micrococcaceae, Genus: Arthrobacter
cagtcgaacgatgatgcccacttgtgggtggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacaacgggtagccggcctgagagggtgaccggccacactgggactgagacacggcccagactcctacgggaggcagcagtggggaatattgcacaatgggcgcaagcctgatgcagcgacgccccgtgagggatgacggccttcgggttgtaaacctctttcagtagggaagaagcgtaagtgacggtacctgcagaaaaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaagatctggaaacaggtcccccacttgtggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggag

SEQ ID NO: 240 - DNA, 1389 bp, Unknown
  Kingdom: Bacteria, Phylum: Actinobacteria, Class: Actinobacteria, Order: Actinomycetales, Family: Micrococcaceae, Genus: Arthrobacter
tgcagtcgaacgatgatcccagcttgctgggggattagtggcgaacgggtgagtaacacgtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggaccgggctggaaacagtccttcccctttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 241 - DNA, 1373 bp, Unknown
  Kingdom: Bacteria, Phylum: Actinobacteria, Class: Actinobacteria, Order: Actinomycetales, Family: Micrococcaceae, Genus: Arthrobacter
tgaagggagcttgctcctggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggtaacgcctggaaacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 242 - DNA, 1376 bp, Unknown
  Kingdom: Bacteria, Phylum: Actinobacteria, Class: Actinobacteria, Order: Actinomycetales, Family: Micrococcaceae, Genus: Arthrobacter
atgatcccagcttgctgggggattagtggcgaacgggtgagtaacacgtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggaccgggctggaaacagtccttcccctttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggag

SEQ ID NO: 243 - DNA, 1387 bp, Unknown
  Kingdom: Bacteria, Phylum: Actinobacteria, Class: Actinobacteria, Order: Actinomycetales, Family: Micrococcaceae, Genus: Arthrobacter
cagtcgaacgatgacctccagcttgctggggtgattagtggcgaacgggtgagtaacacgtgagtaacctgcccttaactctgggataagcctgggaaactgggtctaataccggatatgactcctcatcgcatggtggggggtggaaagctttttgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggaccgggctggaaacagtccttcccctttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggag

SEQ ID NO: 244 - DNA, 1368 bp, Unknown
  Kingdom: Bacteria, Phylum: Actinobacteria, Class: Actinobacteria, Order: Actinomycetales, Family: Micrococcaceae, Genus: Arthrobacter
acttgctgggggattagtggcgaacgggtgagtaacacgtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggaccgggctggaaacagtccttcccctttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 245 - DNA, 1378 bp, Unknown
  Kingdom: Bacteria, Phylum: Actinobacteria, Class: Actinobacteria, Order: Actinomycetales, Family: Micrococcaceae, Genus: Arthrobacter
cgatgatcccagcttgctgggggattagtggcgaacgggtgagtaacacgtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaacacctggaaacaggtgccccgcttgcggtcggtttacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 246 - DNA, 254 bp, Unknown; identical to SEQ ID NO: 166
  Kingdom: Bacteria, Phylum: Actinobacteria, Class: Actinobacteria, Order: Actinomycetales, Family: Micrococcaceae, Genus: Arthrobacter

SEQ ID NO: 247 - DNA, 254 bp, Unknown; identical to SEQ ID NO: 166
  Kingdom: Bacteria, Phylum: Actinobacteria, Class: Actinobacteria, Order: Actinomycetales, Family: Micrococcaceae, Genus: Arthrobacter

SEQ ID NO: 248 - DNA, 254 bp, Unknown; identical to SEQ ID NO: 166
  Kingdom: Bacteria, Phylum: Actinobacteria, Class: Actinobacteria, Order: Actinomycetales, Family: Micrococcaceae, Genus: Arthrobacter

SEQ ID NO: 249 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagttagaggtgaaagcccggagctcaactccggaattgcctttaagactgcatcgcttgaatcatggagaggtgagtggaattccgagtgtagaggtgaaattcgtagatattcggaagaacaccagtggcgaaggcgactcactggacatgtattgacgctgaggtgcgaaagcgtggggagcaaacagg

SEQ ID NO: 250 - DNA, 254 bp, Unknown
  Kingdom: Bacteria, Phylum: Proteobacteria, Class: Betaproteobacteria, Order: Burkholderiales, Family: Comamonadaceae, Genus: Variovorax
atacgtagggtgcaagcgttaatcggaattactgggcgtaaagcgtgcgcaggcggtaatgtaagacagttgtgaaatccccgggctcaacctgggaactgcatctgtgactgcattgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 251 - DNA, 257 bp, Unknown
  Kingdom: Bacteria, Phylum: Firmicutes, Class: Erysipelotrichia, Order: Erysipelotrichales, Family: Erysipelotrichaceae, Genus: Asteroleplasma
agacgtaggtggcgaacgttatccggaatcattgggcgtaaagggtgcgtagatggcatgataagttattagtgggaaatcgaggctcaacctcgtggaagctagtaatactgttttgcttgagtacagaagaggttaacggaactccatgtggagcggtaaaatgcgtagatatatggaagaacatcaataacggcgaaggcagttaactattctgttactgacgttgaggcacgaaagcgtggggagcaaaacgg

SEQ ID NO: 252 - DNA, 254 bp, Unknown
  Kingdom: Bacteria, Phylum: Proteobacteria, Class: Gammaproteobacteria, Order: Xanthomonadales, Family: Xanthomonadaceae, Genus: Stenotrophomonas
atacgaagggtgcaagcgttactcggaattactgggcgtaaagcgtgcgtaggtggtcgtttaagtccgttgtgaaagccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacagg

SEQ ID NO: 253 - DNA, 254 bp, Unknown; identical to SEQ ID NO: 8
  Kingdom: Bacteria, Phylum: Proteobacteria, Class: Alphaproteobacteria, Order: Rhizobiales, Family: Bradyrhizobiaceae, Genus: Bradyrhizobium

SEQ ID NO: 254 - DNA, 254 bp, Unknown; identical to SEQ ID NO: 8
  Kingdom: Bacteria, Phylum: Proteobacteria, Class: Alphaproteobacteria, Order: Rhizobiales, Family: Bradyrhizobiaceae, Genus: Bradyrhizobium

SEQ ID NO: 255 - DNA, 254 bp, Unknown; identical to SEQ ID NO: 63
  Kingdom: Bacteria, Phylum: Proteobacteria, Class: Gammaproteobacteria, Order: Pseudomonadales, Family: Moraxellaceae, Genus: Acinetobacter

SEQ ID NO: 256 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgcaagttagaggtgaaagcccggagcttaactccggaactgcctttaaaactgcatcgctagaatcgtggagaggtgagtggaattccgagtgtagaggtgaaattcgtagatattcggaagaacaccagtggcgaaggcgactcactggacacgtattgacgctgaggtgcgaaagcgtggggagcaaacagg

SEQ ID NO: 257 - DNA, 254 bp, Unknown
  Kingdom: Bacteria, Phylum: Proteobacteria, Class: Gammaproteobacteria, Order: Pseudomonadales, Family: Pseudomonadaceae, Genus: Pseudomonas
atacagagggtgcaagcgttaatcggaattactgggcgtaaagcgcgcgtaggtggttcgttaagttggatgtgaaatccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 258 - DNA, 254 bp, Unknown
  Kingdom: Bacteria, Phylum: Actinobacteria, Class: Actinobacteria, Order: Actinomycetales, Family: Streptomycetaceae, Genus: Streptomyces
atacgtagggcgcaagcgttgtccggaattattgggcgtaaagagctcgtaggcggcttgtcgcgtcggatgtgaaagcccggggcttaaccccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacagg

SEQ ID NO: 259 - DNA, 254 bp, Unknown
  Kingdom: Bacteria, Phylum: Actinobacteria, Class: Actinobacteria, Order: Actinomycetales, Family: Pseudonocardiaceae, Genus: Lechevalieria
atacgtagggtgcgagcgttgtccggaattattgggcgtaaagagctcgtaggcggtttgtcgcgtcggccgtgaaaacttggggcttaaccccgagcctgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 260 - DNA, 254 bp, Unknown
  Kingdom: Bacteria, Phylum: Bacteroidetes, Class: Chitinophagia, Order: Chitinophagales, Family: Chitinophagaceae, Genus: Terrimonas
atacggagggtgcaagcgttatccggattcactgggtttaaagggtgcgtaggtgggttggtaagtcagtggtgaaatccccgagcttaacttgggaactgccattgatactatcagtcttgaatatcgtggaggttagcggaatatgtcatgtagcggtgaaatgcttagatatgacatagaacaccaattgcgaaggcagctggctacacgaatattgacactgaggcacgaaagcgtggggatcaaacagg

SEQ ID NO: 261 - DNA, 254 bp, Unknown
  Kingdom: Bacteria, Phylum: Actinobacteria, Class: Actinobacteria, Order: Actinomycetales, Family: Pseudonocardiaceae, Genus: Lentzea
atacgtagggtgcgagcgttgtccggaattattgggcgtaaagagctcgtaggcggtttgtcgcgtcggccgtgaaaacttggggcttaactccaagcttgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 262 - DNA, 254 bp, Unknown; identical to SEQ ID NO: 85
  Kingdom: Bacteria, Phylum: Proteobacteria, Class: Betaproteobacteria, Order: Burkholderiales, Family: Burkholderiaceae, Genus: Ralstonia

SEQ ID NO: 263 - DNA, 254 bp, Unknown; identical to SEQ ID NO: 85
  Kingdom: Bacteria, Phylum: Proteobacteria, Class: Betaproteobacteria, Order: Burkholderiales, Family: Burkholderiaceae, Genus: Ralstonia

SEQ ID NO: 264 - DNA, 254 bp, Unknown
  Kingdom: Bacteria, Phylum: Proteobacteria, Class: Gammaproteobacteria, Order: Xanthomonadales, Family: Xanthomonadaceae, Genus: Stenotrophomonas
atacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaaggcagctacctggaccaacactgacactgaggcacgaaagcgtggggagcaaacagg

SEQ ID NO: 265 - DNA, 254 bp, Unknown
  Kingdom: Bacteria, Phylum: Proteobacteria, Class: Deltaproteobacteria, Order: Myxococcales, Family: Cystobacteraceae, Genus: Anaeromyxobacter
atacagagggtgcaagcgttgttcggaattattgggcgtaaagcgcgtgtaggcggcctagcaagtcgggtgtgaaagccctcggcttaaccgaggaagtgcgcccgaaactactaggcttgagtaccggagagggtggcggaattcccggtgtagaggtgaaattcgtagatatcgggaggaacaccagcggcgaaggcggccacctggacggatactgacgctgagacgcgaaagcgtggggagcaaacagg

SEQ ID NO: 266 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagttagaggtgaaagcccggagctcaactccggaactgcctttaagactgcatcgcttgaacgtcggagaggtaagtggaattccgagtgtagaggtgaaattcgtagatattcggaagaacaccagtggcgaaggcgacttactggacgactgttgacgctgaggtgcgaaagcgtggggagcaaacagg

SEQ ID NO: 267 - DNA, 1398 bp, Unknown
  Kingdom: Bacteria, Phylum: Proteobacteria, Class: Gammaproteobacteria, Order: Pseudomonadales, Family: Pseudomonadaceae, Genus: Pseudomonas
cgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggtac

SEQ ID NO: 268 - DNA, 1382 bp, Unknown
  Kingdom: Bacteria, Phylum: Proteobacteria, Class: Gammaproteobacteria, Order: Pseudomonadales, Family: Pseudomonadaceae, Genus: Pseudomonas
agaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacaagttcaactagccgtggggagccttgagctcttagtggcgcagttaacgcataaatttgaccgcctggggagtacggccgcaaggttaaaactcaaatgatttgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggagga

SEQ ID NO: 269 - DNA, 1409 bp, Unknown
  Kingdom: Bacteria, Phylum: Proteobacteria, Class: Gammaproteobacteria, Order: Pseudomonadales, Family: Pseudomonadaceae, Genus: Pseudomonas
acatgcagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtggggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtgggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggtacc

SEQ ID NO: 270 - DNA, 254 bp, Unknown; identical to SEQ ID NO: 127
  Kingdom: Bacteria, Phylum: Proteobacteria, Class: Gammaproteobacteria, Order: Pseudomonadales, Family: Pseudomonadaceae, Genus: Pseudomonas

SEQ ID NO: 271 - DNA, 254 bp, Unknown; identical to SEQ ID NO: 127
  Kingdom: Bacteria, Phylum: Proteobacteria, Class: Gammaproteobacteria, Order: Pseudomonadales, Family: Pseudomonadaceae, Genus: Pseudomonas

SEQ ID NO: 272 - DNA, 254 bp, Unknown; identical to SEQ ID NO: 91
  Kingdom: Bacteria, Phylum: Proteobacteria, Class: Betaproteobacteria, Order: Burkholderiales, Family: Oxalobacteraceae, Genus: Duganella

SEQ ID NO: 273 - DNA, 254 bp, Unknown; identical to SEQ ID NO: 26
  Kingdom: Bacteria, Phylum: Proteobacteria, Class: Alphaproteobacteria, Order: Rhizobiales, Family: Rhizobiaceae, Genus: Rhizobium

SEQ ID NO: 274 - DNA, 254 bp, Unknown; identical to SEQ ID NO: 86
  Kingdom: Bacteria, Phylum: Proteobacteria, Class: Betaproteobacteria, Order: Burkholderiales, Family: Burkholderiaceae, Genus: Ralstonia

SEQ ID NO: 275 - DNA, 254 bp, Unknown; identical to SEQ ID NO: 68
  Kingdom: Bacteria, Phylum: Proteobacteria, Class: Gammaproteobacteria, Order: Xanthomonadales, Family: Xanthomonadaceae, Genus: Stenotrophomonas

SEQ ID NO: 276 - DNA, 254 bp, Unknown; identical to SEQ ID NO: 205
  Kingdom: Bacteria, Phylum: Proteobacteria, Class: Alphaproteobacteria, Order: Sphingomonadales, Family: Sphingomonadaceae, Genus: Sphingomonas

SEQ ID NO: 277 - DNA, 254 bp, Unknown
  Kingdom: Bacteria, Phylum: Proteobacteria, Class: Alphaproteobacteria, Order: Rhizobiales, Family: Aurantimonadaceae, Genus: Aureimonas
atacgaagggggctagcgttgttcggaattactgggcgtaaagcgcacgtaggcggatatttaagtcaggggtgaaatcccggggctcaaccccggaactgcctttgatactgggtatcttgagttcggaagaggtaagtggaattgcgagtgtagaggtgaaattcgtagatattcgcaggaacaccagtggcgaaggcggcttactggtccgatactgacgctgaggtgcgaaagcgtggggagcaaacagg

SEQ ID NO: 278 - DNA, 254 bp, Unknown
  Kingdom: Bacteria, Phylum: Proteobacteria, Class: Alphaproteobacteria, Order: Rhodospirillales, Family: Rhodospirillaceae, Genus: Azospirillum
atacgaagggggctagcgttgttcggaattactgggcgtaaagggcgcgtaggcggcctgtttagtcagaagtgaaagccccgggctcaacctgggaatagcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacagg

SEQ ID NO: 279 - DNA, 1411 bp, Unknown
  Kingdom: Bacteria, Phylum: Proteobacteria, Class: Gammaproteobacteria, Order: Enterobacteriales, Family: Enterobacteriaceae, Genus: Pantoea
catgcagtcggacggtagcacagagagcttgctcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttaccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgcattggtgccttcgggaacagtgagacaggtgctgcatggctgtcgtcagctcgtgttgtgaaatgttgggttaagtcccgcaacgagcgcaacccttatcctttgttgccagcgagtgatggcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacc

SEQ ID NO: 280 - DNA, 1401 bp, Unknown
  Kingdom: Bacteria, Phylum: Proteobacteria, Class: Gammaproteobacteria, Order: Enterobacteriales, Family: Enterobacteriaceae, Genus: Pantoea
gtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcattgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggataagttacccgggtattccagcccgaaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactatgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccact

SEQ ID NO: 281 - DNA, 254 bp, Unknown; identical to SEQ ID NO: 76
  Kingdom: Bacteria, Phylum: Proteobacteria, Class: Gammaproteobacteria, Order: Enterobacteriales, Family: Enterobacteriaceae, Genus: Pantoea

SEQ ID NO: 282 - DNA, 254 bp, Unknown; identical to SEQ ID NO: 59
  Kingdom: Bacteria, Phylum: Proteobacteria, Class: Gammaproteobacteria, Order: Pseudomonadales, Family: Pseudomonadaceae, Genus: Pseudomonas

SEQ ID NO: 283 - DNA, 1328 bp, Unknown
  Kingdom: Bacteria, Phylum: Proteobacteria, Class: Alphaproteobacteria, Order: Sphingomonadales, Family: Sphingomonadaceae, Genus: Sphingomonas
cccttcggggtttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgtaa

SEQ ID NO: 284 - DNA, 1329 bp, Unknown
  Kingdom: Bacteria, Phylum: Proteobacteria, Class: Alphaproteobacteria, Order: Sphingomonadales, Family: Sphingomonadaceae, Genus: Sphingomonas
aggcccttcggggtttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgt

SEQ ID NO: 285 - DNA, 1341 bp, Unknown
  Kingdom: Bacteria, Phylum: Proteobacteria, Class: Alphaproteobacteria, Order: Sphingomonadales, Family: Sphingomonadaceae, Genus: Sphingomonas
cttcggatctagtggcgcacgggtgcgtaacgcgtgggaatctgccttggggttcggaataactccccgaaaggggtgctaataccggatgatgtcgaaagaccaaagatttatcgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcgac

SEQ ID NO: 286 - DNA, 1337 bp, Unknown
  Kingdom: Bacteria, Phylum: Proteobacteria, Class: Alphaproteobacteria, Order: Sphingomonadales, Family: Sphingomonadaceae, Genus: Sphingomonas
tcgaacgaaggcttcggccttagtggcgcacgggtgcgtaacgcgtgggaatctgcccttaggttcggaataacagctggaaacggctgctaataccggatgatatcgcgagatcaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgcaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatttcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccagcaa

SEQ ID NO: 287 - DNA, 1298 bp, Unknown
  Kingdom: Bacteria, Phylum: Proteobacteria, Class: Alphaproteobacteria, Order: Sphingomonadales, Family: Sphingomonadaceae, Genus: Sphingomonas
  misc_feature (1237)..(1237): n is a, c, g, or t
atctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccntcacaccatgggagttggattcacccgaaggcgttgcgccaacccgcaagggaagcaggcg

SEQ ID NO: 288 - DNA, 254 bp, Unknown; identical to SEQ ID NO: 204
  Kingdom: Bacteria, Phylum: Proteobacteria, Class: Alphaproteobacteria, Order: Sphingomonadales, Family: Sphingomonadaceae, Genus: Sphingomonas

SEQ ID NO: 289 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttgttcggaattactgggcgtaaagcgcacgtaggcggctttgtaagttagaggtgaaagcccggagctcaactccggaatagcctttaagactgcatcgctagaacgttggagaggtaagtggaattccgagtgtagaggtgaaattcgtagatattcggaagaacaccagtggcgaaggcgacttactggacaactgttgacgctgaggtgcgaaagcgtggggagcaaacagg

SEQ ID NO: 290 - DNA, 254 bp, Unknown; identical to SEQ ID NO: 139
  Kingdom: Bacteria, Phylum: Proteobacteria, Class: Gammaproteobacteria, Order: Xanthomonadales, Family: Xanthomonadaceae, Genus: Stenotrophomonas

SEQ ID NO: 291 - DNA, 254 bp, Unknown
  Kingdom: Bacteria, Phylum: Actinobacteria, Class: Actinobacteria, Order: Actinomycetales, Family: Streptomycetaceae, Genus: Streptomyces
atacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 292 - DNA, 256 bp, Unknown
  Kingdom: Bacteria, Phylum: Firmicutes, Class: Erysipelotrichia, Order: Erysipelotrichales, Family: Erysipelotrichaceae, Genus: Asteroleplasma
gacgtaggtggcgaacgttatccggaattattgggcgtaaagggtgcgtagatggcttgataagttagcagtgggaaatcgaggctcaacctcgtggaagctggtaatactgtcaggctcgagtgcaggagaggttaacggaactccatgtggagcggtaaaatgtgtagatatatggaagaacaccaataacggcgaaggcagttaactattctgttactgacattgaggcacgaaagcgtggggagcaaaacgg

SEQ ID NO: 293 - DNA, 1355 bp, Enterobacter cloacae
agagcttgctctcgggtgacgagtggcgtgacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttgcagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacactatgggagtgggttgcaaaagaa

SEQ ID NO: 294 - DNA, 1387 bp, Unknown
  Kingdom: Bacteria, Phylum: Firmicutes, Class: Erysipelotrichia, Order: Erysipelotrichales, Family: Erysipelotrichaceae, Genus: Asteroleplasma
agagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtcaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctacc

SEQ ID NO: 295 - DNA, 1399 bp, Unknown
  Kingdom: Bacteria, Phylum: Firmicutes, Class: Erysipelotrichia, Order: Erysipelotrichales, Family: Erysipelotrichaceae, Genus: Asteroleplasma
cggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacca

SEQ ID NO: 296 - DNA, 1381 bp, Erwinia aphidicola
cggtagcacagagagcttgctcttgggtgacgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcgatgaagttaatagcttcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaac

SEQ ID NO: 297 - DNA, 1059 bp, Unknown
  Kingdom: Bacteria, Phylum: Firmicutes, Class: Erysipelotrichia, Order: Erysipelotrichales, Family: Erysipelotrichaceae, Genus: Asteroleplasma
agcttgctcttgggtgacgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcgatgaagttaatagctttttcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcaagtaatg

SEQ ID NO: 298 - DNA, 1341 bp, Unknown
  Kingdom: Bacteria, Phylum: Firmicutes, Class: Erysipelotrichia, Order: Erysipelotrichales, Family: Erysipelotrichaceae, Genus: Asteroleplasma
gtagcacagagagcttgctcttgggtgacgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcgatgaagttaatagcttcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcaca

SEQ ID NO: 299 - DNA, 1335 bp, Unknown
  Kingdom: Bacteria, Phylum: Firmicutes, Class: Erysipelotrichia, Order: Erysipelotrichales, Family: Erysipelotrichaceae, Genus: Asteroleplasma
taatgtctgggaaactgcccgatggagggggataactactggaaacggtagctaataccgcataacgtcttcggaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcgatgaagttaatagcttcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaacctc

SEQ ID NO: 300 - DNA, 1265 bp, Unknown
  Kingdom: Bacteria, Phylum: Firmicutes, Class: Erysipelotrichia, Order: Erysipelotrichales, Family: Erysipelotrichaceae, Genus: Asteroleplasma
cgtcttcggaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcgatgaagttaatagcttcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagctta

SEQ ID NO: 301 - DNA, 1395 bp, Ralstonia pickettii
cggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgatac

SEQ ID NO: 302 - DNA, 1403 bp, Unknown
  Kingdom: Bacteria, Phylum: Firmicutes, Class: Erysipelotrichia, Order: Erysipelotrichales, Family: Erysipelotrichaceae, Genus: Asteroleplasma
tgcagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtgaggtaaaggctcaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgat

SEQ ID NO: 303 - DNA, 1395 bp, Ralstonia pickettii; identical to SEQ ID NO: 301

SEQ ID NO: 304 - DNA, 1403 bp, Unknown; identical to SEQ ID NO: 302
  Kingdom: Fungi, Phylum: Ascomycota, Class: Sordariomycetes, Order: Hypocreales, Family: Nectriaceae, Genus: Fusarium

SEQ ID NO: 305 - DNA, 1393 bp, Unknown
  Kingdom: Fungi, Phylum: Ascomycota, Class: Sordariomycetes, Order: Hypocreales, Family: Nectriaceae, Genus: Fusarium
tgcagtcggacggtagcacaggagagcttgctctccgggtgacgagtggcggacgggtgagtaatgtctgggaaactgcccggtggagggggataactactggaaacggtagctaataccgcataacgtcttcggaccaaagtgggggatcttcggacctcacgccaccggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgggtaatgccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaac

SEQ ID NO: 306 - DNA, 1412 bp, Enterobacter cloacae
catgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtcaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttacca

SEQ ID NO: 307 - DNA, 1408 bp, Enterobacter cloacae
catgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcta

SEQ ID NO: 308 - DNA, 1405 bp, Enterobacter cloacae
atgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgc

SEQ ID NO: 309 - DNA, 1409 bp, Enterobacter cloacae
atgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtcaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctacc

SEQ ID NO: 310 - DNA, 1391 bp, Unknown
  Kingdom: Fungi, Phylum: Ascomycota, Class: Dothideomycetes, Order: Pleosporales, Family: Pleosporaceae, Genus: Cochliobolus
gtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcg

SEQ ID NO: 311 - DNA, 989 bp, Unknown
  Kingdom: Fungi, Phylum: Basidiomycota, Class: Tremellomycetes, Order: Tremellales, Family: Incertae_sedis_12, Genus: Hannaella
tgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccac

SEQ ID NO: 312 - DNA, 989 bp, Unknown
  Kingdom: Fungi, Phylum: Ascomycota, Class: Eurotiomycetes, Order: Chaetothyriales, Family: Herpotrichiellaceae, Genus: Exophiala
tgacgttacccgcagaagaagcaccgggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctacca

SEQ ID NO: 313 - DNA, 1409 bp, Unknown
  Kingdom: Fungi, Phylum: Glomeromycota, Class: Glomeromycetes, Order: Glomerales, Family: Glomeraceae, Genus: Rhizophagus
tgcagtcgagcggcagcggagagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacagtgggcgcaagcctgatgcacccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctac

SEQ ID NO: 314 - DNA, 1414 bp, Unknown
  Kingdom: Fungi, Phylum: Basidiomycota, Class: Microbotryomycetes, Order: Sporidiobolales, Family: Sporidiobolaceae, Genus: Sporidiobolus
acacatgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttacc

SEQ ID NO: 315 - DNA, 1415 bp, Unknown
  Kingdom: Fungi, Phylum: Ascomycota, Class: Dothideomycetes, Order: Pleosporales, Family: Leptosphaeriaceae, Genus: Leptosphaeria
catgcagtcgaacggcagcacagaaagagcttgctctctgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggctaatacccggttgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggatgggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgc

SEQ ID NO: 316 - DNA, 1413 bp, Unknown
  Kingdom: Fungi, Phylum: Ascomycota, Class: Dothideomycetes, Order: Pleosporales, Family: Phaeosphaeriaceae, Genus: Ophiosphaerella
catgcagtcgaacggcagcacaggaagagcttgctctctgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggctaatacccggttgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggatgggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgct

SEQ ID NO: 317 - DNA, 1413 bp, Unknown
  Kingdom: Fungi, Phylum: Ascomycota, Class: Dothideomycetes, Order: Pleosporales, Family: Phaeosphaeriaceae, Genus: Ophiosphaerella
tgcagtcgaacggcagcacaggaagagcttgctccctgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggctaatacccggttgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggatgggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgc

SEQ ID NO: 318 - DNA, 1415 bp, Unknown
  Kingdom: Fungi, Phylum: Ascomycota, Class: Dothideomycetes, Order: Pleosporales, Family: Phaeosphaeriaceae, Genus: Ophiosphaerella
tgcagtcgaacggcagcacaggaagagcttgctctctgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggctaatacccggttgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaaggcagctacctgggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggatgggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgcc

SEQ ID NO: 319 - DNA, 1404 bp, Pseudomonas fluorenscens
tgcagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcaaatgagcctaggtcggattagctagttggtgaggtaatggctcaccaaggcgacgatccgtaactggtctgagaggatgatcagtcacactggaactgagacacggtccaaactcctacgggaggcagcagtggggaatattggacaatgggcgaaagcctgatccagccatgccgcgtgtgtgaagaaggtcttcggattgtaaagcactttaagttgggaggaagggcagttacctaatacgtaattgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggtac

SEQ ID NO: 320 - DNA, 1409 bp, Pseudomonas fluorescens
acacatgcagtcgagcggtagagagaagcttgcttctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggtac

SEQ ID NO: 321 - DNA, 1404 bp, Unknown
  Kingdom: Fungi, Phylum: Ascomycota, Class: Dothideomycetes, Order: Pleosporales, Family: Phaeosphaeriaceae, Genus: Ophiosphaerella
tgcagtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggtac

SEQ ID NO: 322 - DNA, 1410 bp, Pantoea ananatis
tgcagtcggacggtagcacagaggagcttgctcctcgggtgacgagtggcggacgggtgagtagtgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacagtgggcgcaagcctgatgcacccatgccgcgtgtatgaagaaggccttcgggttgtaaagtactttcagcggggaggaaggcagtgaggttaataaccttggtgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttggcagagatgccttggtgccttcgggaactgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacc

SEQ ID NO: 323 - DNA, 1414 bp, Pantoea dispersa
catgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccac

SEQ ID NO: 324 - DNA, 1390 bp, Pantoea dispersa
tgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcggccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagctta

SEQ ID NO: 325 - DNA, 1412 bp, Unknown
  Kingdom: Fungi, Phylum: Ascomycota, Class: Dothideomycetes, Order: Pleosporales, Family: Phaeosphaeriaceae, Genus: Ophiosphaerella
tgcagtcggacggtagcacagaggagcttgctcctcgggtgacgagtggcggacgggtgagtagtgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccacactcctacgggaggcagcagtggggaatattgcacagtgggcgcaagcctgatgcacccatgccgcgtgtatgaagaaggccttcgggttgtaaagtactttcagcggggaggaaggcagtgaggttaataaccttactgattgacgttacccgcaaaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgctaccac

SEQ ID NO: 326 - DNA, 1394 bp, Unknown
  Kingdom: Fungi, Phylum: Ascomycota, Class: Dothideomycetes, Order: Pleosporales, Family: Phaeosphaeriaceae, Genus: Ophiosphaerella
catgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttgctgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaac

SEQ ID NO: 327 - DNA, 1395 bp, Unknown
  Kingdom: Fungi, Phylum: Ascomycota, Class: Dothideomycetes, Order: Pleosporales, Family: Phaeosphaeriaceae, Genus: Ophiosphaerella
catgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttattgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacc

SEQ ID NO: 328 - DNA, 826 bp, Sphingomonas sanguinis
ccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacggggcctgcacaagcggtggagcatgtggtttaattcgaagcaacgcgcaaaccttaccagcgtttgacatgtcc

SEQ ID NO: 329 - DNA, 1353 bp, Sphingomonas trueperi
gtcgaacgagatcttcggatctagtggcgcacgggtgcgtaacgcgtgggaatctgccttggggttcggaataactccccgaaaggggtgctaataccggatgatgtcgaaagaccaaagatttatcgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcgac

SEQ ID NO: 330 - DNA, 1342 bp, Sphingomonas yabuuchiae
catgcagtcgaacgaaggcttcggccttagtggcgcacgggtgcgtaacgcgtgggaatctgccctttggttcggaataacagctggaaacggctgctaataccggatgatgacgagagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgactggcagagatgcctttcttcccttcggggactggaacacaggtgctgcatggctgtcgtcagctcgtgtcgtgagatgttgggttaagtcccgcaacgagcgcaaccctcgcctttagttaccatcattgagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgta

SEQ ID NO: 331 - DNA, 1354 bp, Unknown
  Kingdom: Fungi, Phylum: Ascomycota, Class: Dothideomycetes, Order: Pleosporales, Family: Phaeosphaeriaceae, Genus: Ophiosphaerella
ctcagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgca

SEQ ID NO: 332 - DNA, 1410 bp, Unknown
  Kingdom: Fungi, Phylum: Ascomycota, Class: Dothideomycetes, Order: Pleosporales, Family: Incertae_sedis_13, Genus: Phoma
catgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctacc

SEQ ID NO: 333 - DNA, 1410 bp, Unknown
  Kingdom: Fungi, Phylum: Basidiomycota, Class: Tremellomycetes, Order: Tremellales, Family: Tremellaceae, Genus: Cryptococcus
catgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctacc

SEQ ID NO: 334 - DNA, 1337 bp, Erwinia persicina
gcttgcttcttgggtgacgagtggcggacgggtgagtaatgtctgggaaactgcccgatggagggggataactactggaaacggtagctaataccgcataacgtcttcggaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgacgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcagatgtgaaatccccgggcttaacctgggaactgcatttgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgaactcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccagggga

SEQ ID NO: 335 - DNA, 1410 bp, Unknown
  Kingdom: Fungi, Phylum: Basidiomycota, Class: Tremellomycetes, Order: Tremellales, Family: Tremellaceae, Genus: Cryptococcus
tgcagtcgaacggtaacaggaagcagcttgctgcttcgctgacgagtggcggacgggtgagtaatgtctggggatctgcctgatggagggggataactactggaaacggtagctaataccgcataacgtcgcaagaccaaagagggggaccttcgggcctcttgccatcagatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgtgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacc

SEQ ID NO: 336 - DNA, 1405 bp, Unknown
  Kingdom: Fungi, Phylum: Basidiomycota, Class: Tremellomycetes, Order: Tremellales, Family: Tremellaceae, Genus: Cryptococcus
cgaacggtagcacagagagcttgctctcgggtgacgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcgatgaagttaataacttcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccac

SEQ ID NO: 337 - DNA, 1405 bp, Unknown
  Kingdom: Fungi, Phylum: Basidiomycota, Class: Tremellomycetes, Order: Tremellales, Family: Tremellaceae, Genus: Cryptococcus
atgcagtcgagcggtagcacagggagcttgctcctgggtgacaagcggcggacgggtgagtaatgtctgggaaactgcctgatggagggggataactactggaaacggtagctaataccgcataaagtcgcaagaccaaagagggggaccttcgggcctcttgccatcagatgtgcccagatgggattagctagaaggtggggtaatggctcacctaggcgacgatccctagctgggctgagaggatgaccagccacactggaactgagacacggtccaactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcacaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtgccgcctggggagtacggccgcaaggttaaaactcaaatgaattgacgggggcccgccaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcacaaagtatgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctacc

SEQ ID NO: 338 - DNA, 1331 bp, Acinetobacter calcoaceticus
gtgctctgcactatcacttagcggcggacgggtgagtaatgcttaggaatctgcctattagtgggggacaacatttcgaaaggaatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggcggaagcctgatccagccatgccgcgtgtgtgaagaaggccttatggttgtaaagcactttaagcgaggaggaggctactctagttaatacctagggatagtggacgttactcgcagaataagcaccggctaactctgtgccagcagccgcggtaatacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacaggattagataccctggtagtccatgccgtaaacgatgtctactagccgttggggcctttgaggctttagtggcgcagctaacgcgataagtagaccgcctggggagtacggtcgcaagactaaaactcaaatgaattgacgggggcccgcacaagcggtggagcatgtggtttaattcgatgcaacgcgaagaaccttacctggccttgacatagtaagaactttccagagatggattggtgccttcgggaacttacatacaggtgctgcatggctgtcgtcagctcgtgtcgtgagatgttgggttaagtcccgcaacgagcgcaacccttttccttatttgccagcgagtaatgtcgggaactttaaggatactgccagtgacaaactggaggaaggcggggacgacgtcaagtcatcatggcccttacggccagggctacacacgtgctacaatggtcggtacaaagggttgctacctagcgataggatgctaatctcaaaaagccgatcgtagtccggattggagtctgcaactcgactccatgaagtcggaatcgctagtaatcgcggatcagaatgccgcggtgaatacgttcccgggccttgtacacaccgcccgtcaca

SEQ ID NO: 339 - DNA, 1378 bp, Arthrobacter globiformis
tgcagtcgaacgatgatccggtgcttgcaccggtgattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgccgcagaaatgtggtttcccctttggggctggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttg

SEQ ID NO: 340 - DNA, 1269 bp, Arthrobacter humicola
gtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggaccgggctggaaacagtccttcccctttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacacccccc

SEQ ID NO: 341 - DNA, 1329 bp, Arthrobacter oryzae
tgcaagtcgaacgatgatcccagcttgctgggggattagtggcgaacgggtgagtaacacgtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggaccgggctggaaacagtccttcccctttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgccc

SEQ ID NO: 342 - DNA, 1386 bp, Arthrobacter oryzae
tgcagtcgaacgatgatcccagcttgctgggggattagtggcgaacgggtgagtaacacgtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggaccgggctggaaacagtccttcccctttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggaggg

SEQ ID NO: 343 - DNA, 1379 bp, Arthrobacter oryzae
cgatgatcccagcttgctgggggattagtggcgaacgggtgagtaacacgtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgggccggaccgggctggaaacagtccttcccctttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 344 - DNA, 1347 bp, Arthrobacter phenanthrenivorans
gtgcttgcatcggggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggtaacgcctggaaacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtggtaacacccgacagctaggtggc

SEQ ID NO: 345 - DNA, 1014 bp, Unknown
  Kingdom: Fungi, Phylum: Basidiomycota, Class: Tremellomycetes, Order: Tremellales, Family: Tremellaceae, Genus: Cryptococcus
tttcagtaggaaagaagcgaaagtgacggtacctgcagaagaagcgccggctaactacgtgccagcagccgcggtaatacgtagggcgcaagcgttatcccggaattattgggcgtaaagagctcgtaggcggtttgtcgcgtctgcccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgccgcagaaatgtggtttcccctttggggccggtttacaggtggtgcatggttgtcgtcagctcgtgtcgtgagatgttgggttaagtcccgcaacgagcgcaaccctcgttctatgttgccagcggttcggccggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 346 - DNA, 1372 bp, Unknown
  Kingdom: Fungi, Phylum: Basidiomycota, Class: Tremellomycetes, Order: Tremellales, Family: Tremellaceae, Genus: Cryptococcus
gtcgaacgatgatgcccacttgtgggtggattagtggcgaacgggtgagtaacacgggagtaacctgcccttgactctgggataagcctgggaaactgggtctaataccggatatgactgactatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcatcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccagaccgggctggaaacagtccttccccttgtgggttggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttg

SEQ ID NO: 347 - DNA, 1388 bp, Unknown
  Kingdom: Fungi, Phylum: Basidiomycota, Class: Tremellomycetes, Order: Tremellales, Family: Tremellaceae, Genus: Cryptococcus
tgcagtcgaacgatgatctccagcttgctggggggattagtggcgaacgggtgagtaacacgtgagtaacctgcccttgactctgggataagcctgggaaactgggtctaataccggatatgactgactatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgccgcagaaatgtggtttcccctttggggccggtttacaggtggtgcatggttgtcgtcagctcgtgtcgtgagatgttgggttaagtcccgcaacgagcgcaaccctcgttctatgttgccagcggttcggccggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 348 - DNA, 1381 bp, Unknown
  Kingdom: Fungi, Phylum: Basidiomycota, Class: Tremellomycetes, Order: Tremellales, Family: Tremellaceae, Genus: Cryptococcus
cgaacgatgatgcccacttgtgggtggattagtggcgaacgggtgagtaacacgtgagtaacctgcccttgactctgggataagcctgggaaactgggtctaataccggatatgactgactatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccagaccgggctggaaacagtccttccccttgtgggttggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 349 - DNA, 1375 bp, Unknown
  Kingdom: Fungi, Phylum: Basidiomycota, Class: Tremellomycetes, Order: Tremellales, Family: Tremellaceae, Genus: Cryptococcus
cagtcgaacgatgaagggagcttgctcctggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagtagggaagaagcgtaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaacgcctggaaacaggtgccccacttgtggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtgg

SEQ ID NO: 350 - DNA, 1392 bp, Unknown
  Kingdom: Fungi, Phylum: Basidiomycota, Class: Tremellomycetes, Order: Tremellales, Family: Tremellaceae, Genus: Cryptococcus
tgcagtcgaacgatgaagggagcttgctcctggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcggaagcctgatgcagcgacgccgcgtgagggatgacggccttcgggttgtaaacctctttcagtagggaagaagcgtaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaacgcctggaaacaggtgccccacttgtggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtgggggggagccgtcgaa

SEQ ID NO: 351 - DNA, 1328 bp, Unknown
  Kingdom: Fungi, Phylum: Basidiomycota, Class: Tremellomycetes, Order: Tremellales, Family: Tremellaceae, Genus: Cryptococcus
gtgcttgcatcggggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggtaacgcctggaaacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgtaaagttggt

SEQ ID NO: 352 - DNA, 1372 bp, Unknown
  Kingdom: Fungi, Phylum: Basidiomycota, Class: Tremellomycetes, Order: Tremellales, Family: Tremellaceae, Genus: Cryptococcus
tgatgcccacttgtgggtggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaagacctggaaacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggag

SEQ ID NO: 353 - DNA, 1328 bp, Unknown
  Kingdom: Fungi, Phylum: Basidiomycota, Class: Tremellomycetes, Order: Tremellales, Family: Tremellaceae, Genus: Cryptococcus
tgcaagtcgaacgatgatcccagcttgctgggggattagtggcgaacgggtgagtaacacgtgagtaacctgcccttaactctgggataagcctgggaaactgggtctaataccggatatgactcctcatcgcatggtggggggtggaaagctttattgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtggggggggcattccacgttttccgcgcggtagataacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaacacctggaaacaggtgccccgcttgcggtcggtttacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgccc

SEQ ID NO: 354 - DNA, 1327 bp, Unknown
  Kingdom: Fungi, Phylum: Basidiomycota, Class: Tremellomycetes, Order: Tremellales, Family: Tremellaceae, Genus: Cryptococcus
cctgcttggtgggggattagtggggaacgggtgagtaacacgtgagtaacctgcccttaactctgggataagcctgggaaactgggtctaataccggatatgactcctcatcgcatggtggggggtggaaagctttttgtggttttggatggactcgcggcctatcagcttgttggtgaggtaatggcttaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaacgcctggagacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacccctcccgtcaagtcacgaaagtgga

SEQ ID NO: 355 - DNA, 1334 bp, Unknown
  Kingdom: Fungi, Phylum: Basidiomycota, Class: Tremellomycetes, Order: Tremellales, Family: Tremellaceae, Genus: Cryptococcus
tggtggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgagagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccactttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccagaccgggctggaaacagtccttctcctttggggttggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgtaaagttggtaacacccgacagct

SEQ ID NO: 356 - DNA, 1313 bp, Unknown
  Kingdom: Fungi, Phylum: Basidiomycota, Class: Tremellomycetes, Order: Tremellales, Family: Tremellaceae, Genus: Cryptococcus
gtggattagtggcggaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgagagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccagaccgggctggaaacagtccttcccctttggggttggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtgcaccccgccgttcaagtcaggaaag

SEQ ID NO: 357 - DNA, 862 bp, Unknown
  Kingdom: Fungi, Phylum: Basidiomycota, Class: Tremellomycetes, Order: Tremellales, Family: Tremellaceae, Genus: Cryptococcus
agtcgaacgatgatgcccacttgtgggtggattagtggcgaacgggtgagtaacacgtgagtaacctgcccttgactctgggataagcctgggaaactgggtctaataccggatatgactttcatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcgga

SEQ ID NO: 358 - DNA, 1377 bp, Unknown
  Kingdom: Fungi, Phylum: Basidiomycota, Class: Tremellomycetes, Order: Tremellales, Family: Tremellaceae, Genus: Cryptococcus
atgcagtcgaacgatgatgcccacttgtgggtggattagtggcgaacgggtgagtaacacgtgagtaacctgcccttgactctgggataagcctgggaaactgggtctaataccggatatgactgactatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccagaccgggctggaaacagtccttccccttgtgggttggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttg

SEQ ID NO: 359 - DNA, 1382 bp, Unknown
  Kingdom: Fungi, Phylum: Basidiomycota, Class: Tremellomycetes, Order: Tremellales, Family: Tremellaceae, Genus: Cryptococcus
gtcgaacgatgatgcccacttgtgggtggattagtggcgaacgggtgagtaacacgtgagtaacctgcccttgactctgggataagcctgggaaactgggtctaataccggatatgactttcatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccagaccgggctggaaacagtccttccccttgtgggttggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 360 - DNA, 1387 bp, Unknown
  Kingdom: Fungi, Phylum: Basidiomycota, Class: Tremellomycetes, Order: Tremellales, Family: Tremellaceae, Genus: Cryptococcus
tgcaagtcgaacgatgatgcccacttgtgggtggattagtggcgaacgggtgagtaacacgtgagtaacctgcccttgactctgggataagcctgggaaactgggtctaataccggatatgactgactatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccagaccgggctggaaacagtccttccccttgtgggttggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggag

SEQ ID NO: 361 - DNA, 1385 bp, Unknown
  Kingdom: Fungi, Phylum: Ascomycota, Class: Dothideomycetes, Order: Pleosporales, Family: Pleosporaceae, Genus: Alternaria
tgcaagtcgaacgatgacctccagcttgctggggtgattagtggcgaacgggtgagtaacacgtgagtaacctgcccttaactctgggataagcctgggaaactgggtctaataccggatatgactcctcatcgcatggtggggggtggaaagctttttgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggactggatcgctgcagaaatgtggtttcccctttggggctggttcacaggtggtgcatggttgtcgtcagctcgtgtcgtgagatgttgggttaagtcccgcaacgagcgcaaccctcgttctatgttgccagcgcgtgatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtggga

SEQ ID NO: 362 - DNA, 1329 bp, Unknown
  Kingdom: Fungi, Phylum: Ascomycota, Class: Dothideomycetes, Order: Pleosporales, Family: Pleosporaceae, Genus: Alternaria
tgcagtcgaacgatgatctccagcttgctggggggattagtggcgaacgggtgagtaacacgtgagtaacctgcccttaactctgggataagcctgggaaactgggtctaataccggatatgactcctcatcgcatggtggggggtggaaagctttttgtggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgccgcagaaatgtggtttcccctttggggccggttcacaggtggtgcatggttgtcgtcagctcgtgtcgtgagatgttgggttaagtcccgcaacgagcgcaaccctcgttctatgttgccagcgcgtgatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgccc

SEQ ID NO: 363 - DNA, 1380 bp, Unknown
  Kingdom: Fungi, Phylum: Ascomycota, Class: Dothideomycetes, Order: Pleosporales, Family: Pleosporaceae, Genus: Alternaria
tgcaagtcgaacgatgatccggtgcttgcaccggggattagtggcgaacgggtgagtaacacgtgagtaacctgcccttgactctgggataagcctgggaaactgggtctaataccggatatgactcctcatcgcatggtggggggtggaaagcttttgcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatggaccggaccgccgcagaaatgtggtttctccttttggggccggttcacaggtggtgcatggttgtcgtcagctcgtgtcgtgagatgttgggttaagtcccgcaacgagcgcaaccctcgttccatgttgccagcgcgtaatggcggggactcatgggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttg

SEQ ID NO: 364 - DNA, 1387 bp, Unknown
  Kingdom: Fungi, Phylum: Ascomycota, Class: Dothideomycetes, Order: Pleosporales, Family: Pleosporaceae, Genus: Alternaria
tgcaagtcgaacgatgatgcccacttgtgggtggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaagacctggaaacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggagc

SEQ ID NO: 365 - DNA, 1387 bp, Unknown
  Kingdom: Fungi, Phylum: Ascomycota, Class: Sordariomycetes, Order: Hypocreales, Family: Nectriaceae, Genus: Fusarium
catgcagtcgaacgatgatgcccacttgtgggtggattagtggcgaacgggtgagtaacacgtgagtaacctgcccttgactctgggataagcctgggaaactgggtctaataccggatatgaccttccatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaagacctggaaacaggtgccccgcttgcggtcggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaaccccttgtgggagggag

SEQ ID NO: 366 - DNA, 1265 bp, Unknown
  Kingdom: Fungi, Phylum: Mucoromycota, Class: Mortierellales, Order: Mortierellaceae, Family: Mortierella, Genus: Mortierella
gtgagtaacctgcccttgactctgggataagcctgggaaactgggtctaataccggatatgactgactatcgcatggtggttggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccagaccgggctggaaacagtccttccccttgtgggttggtttacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacacccc

SEQ ID NO: 367 - DNA, 1355 bp, Unknown
  Kingdom: Fungi, Phylum: Ascomycota, Class: Dothideomycetes, Order: Pleosporales, Family: Leptosphaeriaceae, Genus: Neosetophoma
tgcagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgctgctaacccgcaagggaggcagcc

SEQ ID NO: 368 - DNA, 1231 bp, Unknown
  Kingdom: Fungi, Phylum: Ascomycota, Class: Dothideomycetes, Order: Pleosporales, Family: Leptosphaeriaceae, Genus: Neosetophoma
ccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgccc

SEQ ID NO: 369 - DNA, 1295 bp, Unknown
  Kingdom: Fungi, Phylum: Ascomycota, Class: Dothideomycetes, Order: Pleosporales, Family: Leptosphaeriaceae, Genus: Neosetophoma
  misc_feature (1235)..(1236): n is a, c, g, or t
gtaccttttggttcggaacaacacagggaaacttgtgctaataccggataagcccttacggggaaagatttatcgccgaaagatcggcccgcgtctgattagctagttggtagggtaacggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccnncacaccatgggagttggctttacctgaagacggtgcgctaaccagcaatggaggcagcc

SEQ ID NO: 370 - DNA, 1351 bp, Unknown
  Kingdom: Fungi, Phylum: Ascomycota, Class: Dothideomycetes, Order: Pleosporales, Family: Leptosphaeriaceae, Genus: Neosetophoma
tgcagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggca

SEQ ID NO: 371 - DNA, 1352 bp, Unknown
  Kingdom: Fungi, Phylum: Ascomycota, Class: Dothideomycetes, Order: Pleosporales, Family: Leptosphaeriaceae, Genus: Neosetophoma
gcagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaacggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaagacggtgcgctaaccagcaatggaggcagc

SEQ ID NO: 372 - DNA, 1235 bp, Unknown
  Kingdom: Fungi, Phylum: Ascomycota, Class: Dothideomycetes, Order: Pleosporales, Family: Leptosphaeriaceae, Genus: Neosetophoma
cgtaccttttggttcggaacaacacagggaaacttgtgctaataccggataagcccttacggggaaagatttatcgccgaaagatcggcccgcgtctgattagctagttggtagggtaacggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgccc

SEQ ID NO: 373 - DNA, 1233 bp, Unknown
  Kingdom: Fungi, Phylum: Ascomycota, Class: Dothideomycetes, Order: Pleosporales, Family: Leptosphaeriaceae, Genus: Neosetophoma
taccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgccc

SEQ ID NO: 374 - DNA, 1224 bp, Unknown
  Kingdom: Fungi, Phylum: Ascomycota, Class: Dothideomycetes, Order: Pleosporales, Family: Leptosphaeriaceae, Genus: Neosetophoma
tttggttcggaacaacacagggaaacttgtgctaataccggataagcccttacggggaaagatttatcgccgaaagatcggcccgcgtctgattagctagttggtagggtaacggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgataaggggcgacccttcgcaaatctcaaaaagccgtctcagttcggattgggctctgcaactcgagcccatgaagttggaatcgctagtaatcgtggatcagcacgccacggtgaatacgttcccgggccttgtacacacc

SEQ ID NO: 375 - DNA, 1355 bp, Unknown; identical to SEQ ID NO: 367
  Kingdom: Fungi, Phylum: Ascomycota, Class: Dothideomycetes, Order: Pleosporales, Family: Leptosphaeriaceae, Genus: Neosetophoma

SEQ ID NO: 376 - DNA, 1231 bp, Unknown; identical to SEQ ID NO: 368
  Kingdom: Fungi, Phylum: Ascomycota, Class: Dothideomycetes, Order: Pleosporales, Family: Leptosphaeriaceae, Genus: Neosetophoma

SEQ ID NO: 377 - DNA, 752 bp, Unknown
  Kingdom: Fungi, Phylum: Ascomycota, Class: Dothideomycetes, Order: Pleosporales, Family: Pleosporaceae, Genus: Cochliobolus
  misc_feature (265)..(265): n is a, c, g, or t
  misc_feature (317)..(317): n is a, c, g, or t
  misc_feature (380)..(380): n is a, c, g, or t
  misc_feature (508)..(508): n is a, c, g, or t
  misc_feature (581)..(581): n is a, c, g, or t
  misc_feature (607)..(607): n is a, c, g, or t
  misc_feature (610)..(610): n is a, c, g, or t
  misc_feature (617)..(617): n is a, c, g, or t
  misc_feature (629)..(630): n is a, c, g, or t
  misc_feature (641)..(641): n is a, c, g, or t
  misc_feature (663)..(663): n is a, c, g, or t
  misc_feature (667)..(668): n is a, c, g, or t
  misc_feature (677)..(678): n is a, c, g, or t
  misc_feature (688)..(688): n is a, c, g, or t
  misc_feature (690)..(691): n is a, c, g, or t
  misc_feature (705)..(705): n is a, c, g, or t
  misc_feature (708)..(708): n is a, c, g, or t
  misc_feature (719)..(721): n is a, c, g, or t
  misc_feature (733)..(733): n is a, c, g, or t
cggaacaacacagggaaacttgtgctaataccggataagcccttacggggaaagatttatcgccgaaagatcggcccgcgtctgattagctagttggtagggtaacggcctaccaaggcgacgatcagtagctggtctgagaggatgatcaaccacattgggactgaaacacggcccaaactcctacgggaggcagcagtggggaatattggacaatgggggcaaccctgatccagccatgccgcgtgagtgatgaaggccctanggttgtaaagctcttttgtgcggaaagataatgacggtaccgcaagaataanccccggctaacttcgtgccagcagccgcggtaatacgaagggggctagcgttgctcggaatcnctgggcgtaaagggtgcgtaggcgggtctttaagtcaggggtgaaatcctggagctcaactccagaactgcctttgatactgaagatcttgagttcgggagaggtgagtggaactgcgagtgtaaggngaaattcgtagatattcgcaagaacaccaatggcgaaggcggctcactggcccgatactgacgctgaggcacnaaagcgtggggagcaaacaggattanatnccctggnagtccacgccgnnacgatgaatgncagccgttagtgtgtttactcnctannggcgcagcnnacgctttaancnntccgcctggggagnacngtcgcaagatnnnaactcaaaaganttgacgggggcccgcacaa

SEQ ID NO: 378 - DNA, 1295 bp, Unknown; identical to SEQ ID NO: 369
  Kingdom: Fungi, Phylum: Ascomycota, Class: Sordariomycetes, Order: Sordariales, Family: Chaetomiaceae, Genus: Humicola
  misc_feature (1235)..(1236): n is a, c, g, or t

SEQ ID NO: 379 - DNA, 1351 bp, Unknown; identical to SEQ ID NO: 370
  Kingdom: Fungi, Phylum: Ascomycota, Class: Sordariomycetes, Order: Sordariales, Family: Chaetomiaceae, Genus: Humicola

SEQ ID NO: 380 - DNA, 1352 bp, Unknown; identical to SEQ ID NO: 371
  Kingdom: Bacteria, Phylum: Proteobacteria, Class: Gammaproteobacteria, Order: Enterobacterales, Family: Enterobacteriaceae, Genus: Enterobacter

SEQ ID NO: 381 - DNA, 1235 bp, Unknown; identical to SEQ ID NO: 372
  Kingdom: Bacteria, Phylum: Proteobacteria, Class: Gammaproteobacteria, Order: Enterobacterales, Family: Enterobacteriaceae, Genus: Enterobacter

SEQ ID NO: 382 - DNA, 1233 bp, Unknown; identical to SEQ ID NO: 373
  Kingdom: Bacteria, Phylum: Proteobacteria, Class: Gammaproteobacteria, Order: Enterobacterales, Family: Enterobacteriaceae, Genus: Enterobacter

SEQ ID NO: 383 - DNA, 1224 bp, Unknown; identical to SEQ ID NO: 374
  Kingdom: Bacteria, Phylum: Proteobacteria, Class: Gammaproteobacteria, Order: Enterobacterales, Family: Erwiniaceae, Genus: Erwinia

SEQ ID NO: 384 - DNA, 254 bp, Unknown
  Kingdom: Bacteria, Phylum: Proteobacteria, Class: Gammaproteobacteria, Order: Enterobacterales, Family: Erwiniaceae, Genus: Erwinia
atacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtaggggtgaaattcgtagatattcgcaagaacaccagtggcgaaggcggctcactggcccgatactgacgctgaggcacgaaagcgtggggagcaaacagg

SEQ ID NO: 385 - DNA, 255 bp, Unknown
  Kingdom: Bacteria, Phylum: Proteobacteria, Class: Gammaproteobacteria, Order: Enterobacterales, Family: Erwiniaceae, Genus: Erwinia
atacgaagggggctagcgttgctcggaatcactgggcgtaaagggtgcgtaggcgggtctttaagtcaggggtgaaatcctggagctcaactccagaactgccttttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 386 - DNA, 1404 bp, Ralstonia pickettii
tgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcgat

SEQ ID NO: 387 - DNA, 1392 bp, Unknown
  Kingdom: Bacteria, Phylum: Proteobacteria, Class: Gammaproteobacteria, Order: Enterobacterales, Family: Erwiniaceae, Genus: Erwinia
cggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcga

SEQ ID NO: 388 - DNA, 1402 bp, Unknown
  Kingdom: Bacteria, Phylum: Proteobacteria, Class: Betaproteobacteria, Order: Burkholderiales, Family: Burkholderiaceae, Genus: Ralstonia
tgcaagtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgctcgaaagagaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcatacagagggttgccaagccgcgaggtggagctaatcccagaaaatgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggctttaccagaagtagttagcctaaccgcaaggagggcg

SEQ ID NO: 389 - DNA, 953 bp, Unknown
  Kingdom: Bacteria, Phylum: Proteobacteria, Class: Betaproteobacteria, Order: Burkholderiales, Family: Burkholderiaceae, Genus: Ralstonia
gtcgaacggcagcatgatctagcttgctagattgatggcgagtggcgaacgggtgagtaatacatcggaacgtgccctgtagtgggggataactagtcgaaagattagctaataccgcatacgacctgagggtgaaagtgggggaccgcaaggcctcatgctataggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatggctctggttaatacctggggtcgatgacggtaccggaagaataaggaccggctaactacgtgccagcagccgcggtaatacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcaga

SEQ ID NO: 390 - DNA, 254 bp, Unknown; identical to SEQ ID NO: 85
  Kingdom: Bacteria, Phylum: Proteobacteria, Class: Betaproteobacteria, Order: Burkholderiales, Family: Burkholderiaceae, Genus: Ralstonia

SEQ ID NO: 391 - DNA, 1361 bp, Unknown
  Kingdom: Bacteria, Phylum: Proteobacteria, Class: Gammaproteobacteria, Order: Enterobacteriales, Family: Enterobacteriaceae, Genus: Pantoea
ttgctctctgggtggcgagtggcggacgggtgaggaatacatcggaatctactctgtcgtgggggataacgtagggaaacttacgctaataccgcatacgacctacgggtgaaagcaggggaccttcgggccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagctggctaatacccggttgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaaggcagctacctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagctaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggta

SEQ ID NO: 392 - DNA, 254 bp, Unknown; identical to SEQ ID NO: 264
  Kingdom: Bacteria, Phylum: Proteobacteria, Class: Gammaproteobacteria, Order: Enterobacteriales, Family: Enterobacteriaceae, Genus: Pantoea

SEQ ID NO: 393 - DNA, 1323 bp, Pseudomonas fluorescens
gcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtgatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggcctttacactccgcccgtc

SEQ ID NO: 394 - DNA, 815 bp, Pseudomonas frederiksbergensis
cctaggaatctgcctggtagtgggggataacgctcggaaacggacgctaataccgcatacgtcctacgggagaaagcaggggaccttcgggccttgcgctatcagatgagcctaggtcggattaactagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcatttacctaatacgtaagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgagtgcgaaagcgtggggagcaaacaggattagataccctggtagtccacgccgtaaaacgatgtcaactagccgttgggagccttgactcttagtggcgcagctaacgcattaagttgaccgcctggggagtacggccgcaaggttaaaactcaaatgaattgacgggggcccgcacaa

SEQ ID NO: 395 - DNA, 1404 bp, Unknown
  Kingdom: Bacteria, Phylum: Proteobacteria, Class: Gammaproteobacteria, Order: Enterobacteriales, Family: Enterobacteriaceae, Genus: Pantoea
tgcagtcgagcggtagagaggtgcttgcacctcttgagagcggcggacgggtgagtaatgcctaggaatctgcctggtagtgggggataacgttcggaaacgaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggtac

SEQ ID NO: 396 - DNA, 1393 bp, Unknown
  Kingdom: Bacteria, Phylum: Proteobacteria, Class: Gammaproteobacteria, Order: Enterobacteriales, Family: Enterobacteriaceae, Genus: Pantoea
catgcagtcgagcggtagagaggtgcttgcacctcttgagagcggcggacgggtgagtaatgcctaggaatctgcctggtagtgggggataacgttcggaaacgaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttc

SEQ ID NO: 397 - DNA, 1259 bp, Unknown
  Kingdom: Bacteria, Phylum: Proteobacteria, Class: Gammaproteobacteria, Order: Enterobacteriales, Family: Enterobacteriaceae, Genus: Pantoea
agtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtcacgccgtaaacgatgtcaactagccgttgggagccttgagcttttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggatcattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcga

SEQ ID NO: 398 - DNA, 1401 bp, Unknown
  Kingdom: Bacteria, Phylum: Proteobacteria, Class: Gammaproteobacteria, Order: Enterobacteriales, Family: Enterobacteriaceae, Genus: Pantoea
agtcgagcggtagagaggtgcttgcacctcttgagagcggcggacgggtgagtaatgcctaggaatctgcctggtagtgggggataacgctcggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcattaacctaatacgttagtgttttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggagcattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcggggggacggtac

SEQ ID NO: 399 - DNA, 1383 bp, Unknown
  Kingdom: Bacteria, Phylum: Proteobacteria, Class: Gammaproteobacteria, Order: Enterobacteriales, Family: Enterobacteriaceae, Genus: Pantoea
ggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaactttgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacaccccgcccgtcacaccatgggagtgggttgcaccagaagtagctagtctaaccttcgggaggacggt

SEQ ID NO: 400 - DNA, 1366 bp, Unknown
  Kingdom: Bacteria, Phylum: Proteobacteria, Class: Gammaproteobacteria, Order: Enterobacteriales, Family: Enterobacteriaceae, Genus: Pantoea
attcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacg

SEQ ID NO: 401 - DNA, 1404 bp, Unknown
  Kingdom: Bacteria, Phylum: Proteobacteria, Class: Gammaproteobacteria, Order: Enterobacteriales, Family: Enterobacteriaceae, Genus: Pantoea
  misc_feature (698)..(699): n is a, c, g, or t
  misc_feature (753)..(753): n is a, c, g, or t
  misc_feature (762)..(762): n is a, c, g, or t
tgcagtcgagcggatgaagggagcttgctcctgaattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactganntgcgaaagcgtggggagcaaacaggattagataccctggtagtccacgccgtanacgatgtcnactagccgttgggagccttgagctcttagtggcgcagctaacgcattaagttgaccgcctggggagtacgggcgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggtac

SEQ ID NO: 402 - DNA, 255 bp, Unknown
  Kingdom: Bacteria, Phylum: Proteobacteria, Class: Gammaproteobacteria, Order: Enterobacteriales, Family: Enterobacteriaceae, Genus: Pantoea
atacgaacgggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 403 - DNA, 254 bp, Unknown; identical to SEQ ID NO: 54
  Kingdom: Bacteria, Phylum: Proteobacteria, Class: Gammaproteobacteria, Order: Enterobacteriales, Family: Enterobacteriaceae, Genus: Pantoea

SEQ ID NO: 404 - DNA, 1404 bp, Ralstonia pickettii; identical to SEQ ID NO: 386

SEQ ID NO: 405 - DNA, 1392 bp, Unknown; identical to SEQ ID NO: 387
  Kingdom: Bacteria, Phylum: Proteobacteria, Class: Gammaproteobacteria, Order: Enterobacteriales, Family: Enterobacteriaceae, Genus: Pantoea

SEQ ID NO: 406 - DNA, 1402 bp, Unknown; identical to SEQ ID NO: 388
  Kingdom: Bacteria, Phylum: Proteobacteria, Class: Gammaproteobacteria, Order: Enterobacteriales, Family: Enterobacteriaceae, Genus: Pantoea

SEQ ID NO: 407 - DNA, 953 bp, Unknown; identical to SEQ ID NO: 389
  Kingdom: Bacteria, Phylum: Proteobacteria, Class: Gammaproteobacteria, Order: Enterobacteriales, Family: Enterobacteriaceae, Genus: Pantoea

SEQ ID NO: 408 - DNA, 254 bp, Unknown; identical to SEQ ID NO: 86
  Kingdom: Bacteria, Phylum: Proteobacteria, Class: Gammaproteobacteria, Order: Enterobacteriales, Family: Enterobacteriaceae, Genus: Pantoea

SEQ ID NO: 409 - DNA, 254 bp, Unknown; identical to SEQ ID NO: 73
  Kingdom: Bacteria, Phylum: Proteobacteria, Class: Gammaproteobacteria, Order: Enterobacteriales, Family: Enterobacteriaceae, Genus: Pantoea

SEQ ID NO: 410 - DNA, 1037 bp, Pantoea agglomerans
aaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacc

SEQ ID NO: 411 - DNA, 1411 bp, Pantoea ananatis
tgcagtcggacggtagcacagagagcttgctcttgggtgacgagtgggggacgggtgagtaatgtctggggatctgcccgatagagggggataaccactggaaacggtggctaataccgcataacgtcgcaagaccaaagagggggaccttcgggcctctcactatcggatgaaccccgatgggattagctagtaggcggggtaatgggccacctaggcgacaatccctagctggtctgagaggatgaccagccacactggaactgagacacggtccagactcctacgggaggcagcagtggggaatattgcacaatgggcgcaagcctgatgcacccatgccgcgtgtatgaaaaaagccttcgggttgtaaagtactttcagcggggaggaaggcgatgtggttaataaccccatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccac

SEQ ID NO: 412 - DNA, 1410 bp, Pantoea ananatis
tgcagtcggacggtagcacagagagcttgctcttgggtgacgagtggcggacgggtgagtaatgtctggggatctgcccgatagagggggataaccactggaaacggtggctaataccgcataacgtcgcaagaccaaagagggggaccttcgggcctctcactatcggatgaaccccgatgggattagctagtaggcggggtaatggcccacctaggcgacaatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttacc

SEQ ID NO: 413 - DNA, 1408 bp, Pantoea ananatis
tgcagtcggacggtagccagagagcttgctcctgggtgacgagtggcggacgggtgagtaatgtgtggggatctgcccgatagagggggatatccactgggaacggtggctaataccgcataacatcgcaggacccaagagggggaccttcggggctctctctatcggatgaaccccgatgggattagctagtaggcgggggaatggcccacctaagcgacaatacctggctggtctgagagaatgaccaccctcactgtaactgagacacggtccacactcctacgggaggcggcactggggaatattgcgcaatgggcgcaagcctgatgcatccctgccgcgtgtatgaaaaaagccttctggttgtaaagtactttcaccggggaggaaagcgatgtggttaataaccgcaccgattgacgttacccgcaaaaaaaacaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctcgggagggcgctacca

SEQ ID NO: 414 - DNA, 1412 bp, Pantoea ananatis
catgcagtcggacggtagcacagagagcttgctcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttgcagagatgctttggtgccttcgggaactctgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacca

SEQ ID NO: 415 - DNA, 1413 bp, Pantoea ananatis
catgcagtcggacggtagcacagagagcttgctcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcatcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttggcagagatgccttggtgccttcgggaactgtgagacaggtgctgcatggctgtcgtcagctcgtgttgtgaaatgttgggttaagtcccgcaacgagcgcaacccttatcctttgttgccagcgagtgatgtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttacca

SEQ ID NO: 416 - DNA, 1410 bp, Unknown
  Kingdom: Bacteria, Phylum: Proteobacteria, Class: Gammaproteobacteria, Order: Enterobacteriales, Family: Enterobacteriaceae, Genus: Pantoea
tgcagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaatttgccagagatgcattggtgccttcgggaactgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacc

SEQ ID NO: 417 - DNA, 1409 bp, Unknown
  Kingdom: Bacteria, Phylum: Proteobacteria, Class: Gammaproteobacteria, Order: Enterobacteriales, Family: Enterobacteriaceae, Genus: Pantoea
tgcagtcggacggtagcacagagagcttgctcttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgcgtcatggcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacc

SEQ ID NO: 418 - DNA, 1408 bp, Unknown
  Kingdom: Bacteria, Phylum: Proteobacteria, Class: Gammaproteobacteria, Order: Enterobacteriales, Family: Enterobacteriaceae, Genus: Pantoea
  misc_feature (1393)..(1393): n is a, c, g, or t
gcagtcggacggtagcacagaagagcttgctcttcgggtgacgagtggcggacgggtgagtaatgtctggggatctgcccgatggagggggataaccactggaaacggtggctaataccgcataacgtcgcaagaccaaagtgggggaccttcgggcctcacaccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggggaaatggttaataaccattttcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgctcttgacatccacggaattctgcagagatgcggaagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagcagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccntagggagggcgctac

SEQ ID NO: 419 - DNA, 1405 bp, Unknown
  Kingdom: Bacteria, Phylum: Proteobacteria, Class: Gammaproteobacteria, Order: Enterobacteriales, Family: Enterobacteriaceae, Genus: Pantoea
  misc_feature (59)..(59): n is a, c, g, or t
tgcagtcggacggtagcacagaagagcttgctcttcgggtgacgagtggcggacgggtnagtaatgtctggggatctgcccgatggagggggataaccactggaaacggtggctaataccgcataacgtcgcaagaccaaagtgggggaccttcgggcctcacaccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggggaaatggttaataaccattttcattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgctcttgacatccacggaattctgcagagatgcggaagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagcagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttagggagggcg

SEQ ID NO: 420 - DNA, 1355 bp, Sphingomonas azotifigens
tgcagtcgaacgagatcttcggatctagtggcgcacgggtgcgtaacgcgtgggaatctgccttggggttcggaataactccccgaaaggggtgctaataccggatgatgtcgaaagaccaaagatttatccccctgaaatgaacccccgtaagattagctagttggtgtggtaaaggggcaccaaggcgaccatccttaactggtctgaaaggatgatcagccccactgggactgaaacacggcccagactcctacgggagggagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgac

SEQ ID NO: 421 - DNA, 1360 bp, Unknown
  Kingdom: Bacteria, Phylum: Proteobacteria, Class: Gammaproteobacteria, Order: Enterobacteriales, Family: Enterobacteriaceae, Genus: Pantoea
tgcaagtcgaacgagatccttcgggatctagtggcgcacgggtgcgtaacgcgtgggaatctgccttggggttcggaataactccccgaaaggggtgctaataccggatgatgtcgaaagaccaaagatttatcgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcgac

SEQ ID NO: 422 - DNA, 1355 bp, Sphingomonas trueperi
tgcagtcgaacgagatcttcggatctagtggcgcacgggtgcgtaacgcgtgggaatctgccttggggttcggaataactccccgaaaggggtgctaataccggatgatgtcgaaagaccaaagatttatcgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcg

SEQ ID NO: 423 - DNA, 1343 bp, Unknown
  Kingdom: Bacteria, Phylum: Proteobacteria, Class: Gammaproteobacteria, Order: Enterobacteriales, Family: Enterobacteriaceae, Genus: Pantoea
agatcttcggatctagtggcgcacgggtgcgtaacgcgtgggaatctgccttggggttcggaataactccccgaaaggggtgctaataccggatgatgtcgaaagaccaaagatttattgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaagggtaaaactcaaaggaattgacgggggcctgcacaagccgtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcg

SEQ ID NO: 424 - DNA, 1345 bp, Unknown
  Kingdom: Bacteria, Phylum: Proteobacteria, Class: Gammaproteobacteria, Order: Enterobacteriales, Family: Enterobacteriaceae, Genus: Pantoea
agatcttcggatctagtggcgcacgggtgcgtaacgcgtgggaatctgccttggggttcggaataactccccgaaaggggtgctaataccggatgatgtcgaaagaccaaagatttatcgccctgagatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatggtaggacgactggcagagatgcctttcttcccttcggggacctacacacaggtgctgcatggctgtcgtcagctcgtgtcgtgagatgttgggttaagtcccgcaacgagcgcaaccctcgactttagttaccatcattaagttgggtactttaaagtaaccgccggtgataagccggaggaaggtggggatgacgtcaagtcctcatggcccttacgcgctgggctacacacgtgctacaatggcaagtacagtgggcagcaatcccgcgagggtgagctaatctccaaaacttgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcagcaatgagaggcaggcgac

SEQ ID NO: 425 - DNA, 446 bp, Fusarium redolens
ggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagccttatggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaataagcggagg

SEQ ID NO: 426 - DNA, 514 bp, Fusarium redolens
tcccaacccctgtgacataccttactgttgcctcggcggatcagcccgcgcccggtaaaacgggacggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcctctctggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaataagcggagga

SEQ ID NO: 427 - DNA, 514 bp, Fusarium redolens; identical to SEQ ID NO: 426

SEQ ID NO: 428 - DNA, 500 bp, Fusarium redolens
acccctgtgacataccttactgttgcctcggcggatcagcccgcgcccggtaaaacgggacggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagccttatggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaataa

SEQ ID NO: 429 - DNA, 500 bp, Fusarium redolens
cccctgtgaacataccttactgttgcctcggcggatcagcccgcgcccggtaaaacgggacggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagccttatggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaataa

SEQ ID NO: 430 - DNA, 499 bp, Fusarium redolens
ccctgtgacataccttactgttgcctcggcggatcagcccgcgcccggtaaaacgggacggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcctctctggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaataa

SEQ ID NO: 431 - DNA, 507 bp, Fusarium redolens
cccctgtgacataccttactgttgcctcggcggatcagcccgcgcccggtaaaacgggacggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagccttatggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaataagcggagga

SEQ ID NO: 432 - DNA, 498 bp, Fusarium redolens
ccctgtgacataccttactgttgcctcggcggatcagcccgcgcccggtaaaacgggacggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcctctctggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaata

SEQ ID NO: 433 - DNA, 980 bp, Fusarium redolens
tcgcccttcttggtcatttagaggaagtaaaagtcgtaacaaggtctccgttggtgaaccagcggagggatcattaccgagtttacaactcccaaacccctgtgaacataccttactgttgcctcggcggatcagcccgcgcccggtaaaacgggacggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagccttatggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaataagcggaggaaagggcgaattcgtttaaacctgcaggactagtccctttagtgagggttaattctgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggcgttcggctgcggcgagcggtatcagctcactcaaaggcggtaata

SEQ ID NO: 434 - DNA, 545 bp, Fusarium redolens
gttggtgaccagcggagggatcattaccgagtttacaactcccaaacccctgtgaacataccttactgttgcctcggcggatcagcccgcgcccggtaaaacgggacggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcctctctggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaat

SEQ ID NO: 435 - DNA, 257 bp, Unknown
  Kingdom: Bacteria, Phylum: Proteobacteria, Class: Gammaproteobacteria, Order: Enterobacteriales, Family: Enterobacteriaceae, Genus: Pantoea
aacgcacattgcgcccgccagtattctggcgggcatgcctgttcgagcgtcatttcaaccctcaagccctcgggtttggtgttggggatcggcgagccttatggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaa

SEQ ID NO: 436 - DNA, 257 bp, Unknown; identical to SEQ ID NO: 435
  Kingdom: Bacteria, Phylum: Proteobacteria, Class: Gammaproteobacteria, Order: Enterobacteriales, Family: Enterobacteriaceae, Genus: Pantoea

SEQ ID NO: 437 - DNA, 506 bp, Fusarum redolens
cctgtgacataccttactgttgcctcggcggatcagcccgcgcccggtaaaacgggacggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcctctctggcaagccggccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaataagcggagga

SEQ ID NO: 438 - DNA, 245 bp, Unknown
  Kingdom: Bacteria, Phylum: Proteobacteria, Class: Gammaproteobacteria, Order: Enterobacteriales, Family: Enterobacteriaceae, Genus: Pantoea
aacgcacattgcgcccgccagtattctggcgggcatgcctgttcgagcgtcatttcaaccctcaagcccagcttggtgttgggagctgcagtcctgctacactccccaaatacattggcggtcacgtcgagcttccatagcgtagtaatttacacatcgttactggtaatcgtcgcggccacgccgttaaaccccaacttctgaatgttgacctcggatcaggtaggaatacccgctgaacttaa

SEQ ID NO: 439 - DNA, 276 bp, Unknown
  Kingdom: Bacteria, Phylum: Proteobacteria, Class: Gammaproteobacteria, Order: Enterobacteriales, Family: Enterobacteriaceae, Genus: Enterobacter
aacgcatcttgcgccctctggtattccggggggcatgcctgttcgagcgtcattatcacccctcaagcccggcttgttgttggatgcggcggcggcctttagtggcgtaccgcccgtctcaaagataatgacggcgtctgtgaggactcctgtacactgagctttcgggcacgtactaggctgatactcgcagacccggtctttagggctcgcttcggcggcccaacttttaccaaggttgacctcggatcaggtaggaatacccgctgaacttaa

SEQ ID NO: 440 - DNA, 285 bp, Unknown
  Kingdom: Bacteria, Phylum: Proteobacteria, Class: Gammaproteobacteria, Order: Enterobacteriales, Family: Enterobacteriaceae, Genus: Enterobacter
aacgcacattgcgccctttggtattccgaagggcatgcctgttcgagcgtcattatcacccctcaagccttcggcttggtgttggacggtttggtggaggcccccccgcggggccaccgcccctcccaaagacaatgacggcggcctcgttggacccccggtacactgagttcttcacgggacacgtatcggacacatgggtttacgggacacggtctgcctcccctcagggagaatctttctaaggttgacctcggatcaggtagggagacccgcggaacttaa

SEQ ID NO: 441 - DNA, 334 bp, Unknown
  Kingdom: Bacteria, Phylum: Proteobacteria, Class: Gammaproteobacteria, Order: Enterobacteriales, Family: Enterobacteriaceae, Genus: Enterobacter
aacgcatcttgcgccttttggtattccaaaaggcacacctgtttgagtgtcatgaaaccctctcacaaaataaataatttttattatgatttttgtggatgttgagtgctgctgtgttacacatagctcactttaaatgtataagtcatcttctttatatagcaaaaaagaagagatggattgacttgatgtgtaataatttttttttcatcacattgaggaaagtagcaatacttgccatctttatattattttgttgttgagatagagactactaaacaaacaatttaaaatttaagacctcaaatcaggtgggactacccgctgaacttaa

SEQ ID NO: 442 - DNA, 259 bp, Unknown
  Kingdom: Bacteria, Phylum: Proteobacteria, Class: Gammaproteobacteria, Order: Enterobacteriales, Family: Enterobacteriaceae, Genus: Enterobacter
aacgcacattgcgccctttggtattccaaagggcatgcctgttcgagcgtcatttgtaccctcaagctttgcttggtgttgggcgttttttgtctttggttttgtccaaagactcgccttaaaacgattggcagccggcctactggtttcgcagcgcagcacatttttgcgcttgcaatcagcaaaagaggacggcactccatcaagactctatatcacttttgacctcggatcaggtagggatacccgctgaacttaa

SEQ ID NO: 443 - DNA, 214 bp, Unknown
  Kingdom: Bacteria, Phylum: Proteobacteria, Class: Gammaproteobacteria, Order: Enterobacteriales, Family: Enterobacteriaceae, Genus: Pantoea
aacgcacattgcgccttttggtattccgaaaggcatgcctgtttgagtgtcatatcacctctcatatctagttttctatatatgagctttggacgttgccagcaatggctcgtcttaaatgactaagtggaatgcgtaataagttttcgctccctccactctaataacttttatgttagacctcaaatcaggtaggactacccgctgaacttaa

SEQ ID NO: 444 - DNA, 284 bp, Unknown
  Kingdom: Bacteria, Phylum: Proteobacteria, Class: Gammaproteobacteria, Order: Xanthomonadales, Family: Xanthomonadaceae, Genus: Stenotrophomonas
aacgcacattgcgccctttggtattccgaagggcatgcctgttcgagcgtcattatcacccctcaagccctcggcttggtgttggacggtttggtggaggccccctcgggggttcctgcccctcccaaagacaatgacggcggcctcgttggacccccggtacactgagttcttcacgggacacgtatcggacacatgggtttacgggacacggtctgcctcccctcagggagaatctttctaaggttgacctcggatcaggtagggatacccgctgaacttaa

SEQ ID NO: 445 - DNA, 290 bp, Unknown
  Kingdom: Bacteria, Phylum: Proteobacteria, Class: Gammaproteobacteria, Order: Xanthomonadales, Family: Xanthomonadaceae, Genus: Stenotrophomonas
aacgcaaattgcactctcttcggagagtatgcctgtttgagggtcagtattaataaaaatcggcgtgttgctcttttgtgacgttccggagtttgggtcatcttataacaacaccctttcagggtatttttaagaggcttaaaattgaccttttttgtgcatttttagacgtacataaatttttatcttaatgcacaaatctattagatgcgaccatatcgtgtggttccgtgtctataaatttttcatgatttgacctcaaatcaggtaagaacacccgctgaacttaa

SEQ ID NO: 446 - DNA, 299 bp, Unknown
  Kingdom: Bacteria, Phylum: Proteobacteria, Class: Gammaproteobacteria, Order: Xanthomonadales, Family: Xanthomonadaceae, Genus: Stenotrophomonas
aacgcacattgcgccccctggtattccggagagcatgtctgtttgagtgtcatgaattcttcaacccaatcttttcttgtaatcgattggtgtttggattctgagcgttgctggcgtttgcctagctcgttcgtaatacattagcatccctaatacaagtttggattgacttggcgtaatagactattcgctaaggattcggtggaaacatcgagccaacttcattaaggaagctcctaatttaaaagtctaccttttgattagatctcaaatcaggcaggattacccgctgaacttaa

SEQ ID NO: 447 - DNA, 243 bp, Unknown
  Kingdom: Bacteria, Phylum: Proteobacteria, Class: Gammaproteobacteria, Order: Xanthomonadales, Family: Xanthomonadaceae, Genus: Stenotrophomonas
aacgcacattgcgccccttggtattccatggggcatgcctgttcgagcgtcatttgtaccctcaagctctgcttggtgttgggtgtttgtctactatcgtggactcgccttaaagtcattggcagccagtgttttggtattggagcgcagcacattttgcgcctctagcctagaacactagcgtccagtaagccttttttcacttttgacctcggatcaggtagggatacccgctgaacttaa

SEQ ID NO: 448 - DNA, 250 bp, Unknown
  Kingdom: Bacteria, Phylum: Proteobacteria, Class: Gammaproteobacteria, Order: Xanthomonadales, Family: Xanthomonadaceae, Genus: Stenotrophomonas
aacgcacattgcgccccttggtattccatggggcatgcctgttcgagcgtcatttgtaccctcaagctctgcttggtgttgggtgttttgtcctctccattgcgtttggactcgccttaaagcaattggcagccagtgtattggttttaagcgcagcacatcttgcgtcttattcttataacactagcgtccattaagcctttttatcacttttgacctcggatcaggtagggatacccgctgaacttaa

SEQ ID NO: 449 - DNA, 526 bp, Macrophomina phaseolina
tcgggctccgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagca

SEQ ID NO: 450 - DNA, 521 bp, Macrophomina phaseolina
gtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcatatc

SEQ ID NO: 451 - DNA, 518 bp, Macrophomina phaseolina
gtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcat

SEQ ID NO: 452 - DNA, 519 bp, Macrophomina phaseolina
gtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcata

SEQ ID NO: 453 - DNA, 516 bp, Macrophomina phaseolina
cccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcat

SEQ ID NO: 454 - DNA, 523 bp, Macrophomina phaseolina
gtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcatatcaa

SEQ ID NO: 455 - DNA, 543 bp, Macrophomina phaseolina
tcgggctccgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcatatcaataagcggagga

SEQ ID NO: 456 - DNA, 528 bp, Macrophomina phaseolina
attcgggctccgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagca

SEQ ID NO: 457 - DNA, 532 bp, Macrophomina phaseolina
tcgggctccgtcccgatcctcccaccctttgtatacctacctctgttgctttggcgggccgcggtcttccgcggccgccccccgattttggggggtggctagtgcccgccagaggactatcaaactccagttagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcatatcaa

SEQ ID NO: 458 - DNA, 525 bp, Macrophomina phaseolina
tcgggctcgtccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcat

SEQ ID NO: 459 - DNA, 526 bp, Macrophomina phaseolina
tcgggctcgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacccctcgcttcggagcgtaaggcgtcgcccgccggacgaaccttctgaacttttctcaaggttgacctcggatcaggtagggatacccgctgaacttaagcat

SEQ ID NO: 460 - DNA, 526 bp, Macrophomina phaseolina
tcgggctcgtccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcata

SEQ ID NO: 461 - DNA, 525 bp, Macrophomina phaseolina; identical to SEQ ID NO: 458

SEQ ID NO: 462 - DNA, 521 bp, Macrophomina phaseolina
gctccgtccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagca

SEQ ID NO: 463 - DNA, 525 bp, Macrophomina phaseolina; identical to SEQ ID NO: 458

SEQ ID NO: 464 - DNA, 452 bp, Unknown
  Kingdom: Bacteria, Phylum: Proteobacteria, Class: Gammaproteobacteria, Order: Xanthomonadales, Family: Xanthomonadaceae, Genus: Stenotrophomonas
cctagagttgcgggctttgcctgctatctcttacccatgtcttttgagtacttacgtttcctcggcgggtccgcccgccgaagacaaactataaaacctttgcagttgcaatcagcgtctgaacaaatttaaatatttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctttgcttggtgttgggtgtttgtctcgcctctgcgtgtagactcgcctcaaaacaattggcagccggcgtattgatttcggagcgcagtacatctcgcgctttgcactcataacgacgacgtccaaaagtacatttttacact

SEQ ID NO: 465 - DNA, 553 bp, Unknown
  Kingdom: Bacteria, Phylum: Proteobacteria, Class: Gammaproteobacteria, Order: Xanthomonadales, Family: Xanthomonadaceae, Genus: Stenotrophomonas
gtgaattaaacatgcttggtgtcttcgcttcggcaaggcccttgcttaactcacatcccaacacctgtgaactgtaaggcgcatgactaggttcgcccaagtcatcgtctgccctttttaacaaacaattaatgtaacaaacgtagtcttattataacctaataaaactttcaacaacggatctcttggctctcgcatcgatgaagaacgcagcgaaatgcgataagtaatgtgaattgcagaattcagtgaatcatcgaatctttgaacgcaccttgcgctctttggtattccgaagagcatgcctgtttgagtgtcatgaaaatatcaaccttgacttgggttttgtgctctagtctcggcttggaattgggtgcttgccgcttttacgagcggctcaccttaaatgtattagctggatctgtctttgagacttggtttgacttggcgtaataagtatttcgctaaggacattcttcggagtggcctcgtttctaggacgcttgtccgctttccaatacaagttccacctcgtggacatgactttttatta

SEQ ID NO: 466 - DNA, 437 bp, Unknown
  Kingdom: Bacteria, Phylum: Proteobacteria, Class: Gammaproteobacteria, Order: Xanthomonadales, Family: Xanthomonadaceae, Genus: Stenotrophomonas
caacccctgtgacataccacttgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagcacagcttggtgttgggactcgcgttaattcgcgttcctcaaattgattggcggtcacgtcgagcttccatagcgtagtagtaaaaccctcgttactggtaatcgtcgcggccacgccgttaaaccccaacttctgaat

SEQ ID NO: 467 - DNA, 511 bp, Alternaria eichhorniae
gggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatc

SEQ ID NO: 468 - DNA, 511 bp, Alternaria eichhorniae
gcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagccttttttttcaacttttgacctcggatcaggtagggatacccgctgaacttaagcat

SEQ ID NO: 469 - DNA, 508 bp, Alternaria eichhorniae
gggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcat

SEQ ID NO: 470 - DNA, 508 bp, Alternaria eichhorniae; identical to SEQ ID NO: 469

SEQ ID NO: 471 - DNA, 508 bp, Alternaria eichhorniae; identical to SEQ ID NO: 469

SEQ ID NO: 472 - DNA, 502 bp, Alternaria eichhorniae
ggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 473 - DNA, 502 bp, Alternaria eichhorniae
gacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcat

SEQ ID NO: 474 - DNA, 501 bp, Alternaria eichhorniae
gacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 475 - DNA, 502 bp, Alternaria eichhorniae; identical to SEQ ID NO: 473

SEQ ID NO: 476 - DNA, 502 bp, Alternaria eichhorniae; identical to SEQ ID NO: 473

SEQ ID NO: 477 - DNA, 505 bp, Alternaria eichhorniae
acctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatca

SEQ ID NO: 478 - DNA, 501 bp, Alternaria eichhorniae
acctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcat

SEQ ID NO: 479 - DNA, 507 bp, Alternaria eichhorniae
gacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaa

SEQ ID NO: 480 - DNA, 502 bp, Alternaria eichhorniae; identical to SEQ ID NO: 472

SEQ ID NO: 481 - DNA, 507 bp, Alternaria eichhorniae
ggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagccttttttttcaacttttgacctcggatcaggtagggatacccgctgaacttaagcatatc

SEQ ID NO: 482 - DNA, 506 bp, Alternaria eichhorniae
gggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagc

SEQ ID NO: 483 - DNA, 509 bp, Alternaria eichhorniae
cgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcat

SEQ ID NO: 484 - DNA, 508 bp, Alternaria eichhorniae; identical to SEQ ID NO: 469

SEQ ID NO: 485 - DNA, 510 bp, Alternaria eichhorniae
gcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcat

SEQ ID NO: 486 - DNA, 509 bp, Alternaria eichhorniae
gcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 487 - DNA, 510 bp, Alternaria eichhorniae; identical to SEQ ID NO: 485

SEQ ID NO: 488 - DNA, 507 bp, Alternaria eichhorniae
gggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 489 - DNA, 509 bp, Alternaria eichhorniae; identical to SEQ ID NO: 486

SEQ ID NO: 490 - DNA, 511 bp, Alternaria eichhorniae
gcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcata

SEQ ID NO: 491 - DNA, 508 bp, Alternaria eichhorniae; identical to SEQ ID NO: 469

SEQ ID NO: 492 - DNA, 498 bp, Alternaria eichhorniae
cctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagc

SEQ ID NO: 493 - DNA, 500 bp, Unknown
  Kingdom: Bacteria, Phylum: Actinobacteria, Class: Actinobacteria, Order: Actinomycetales, Family: Micrococcaceae, Genus: Arthrobacter
gatctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagccttttttcaacttttgacctcggatcaggtagggatacccgctgaacttaagca

SEQ ID NO: 494 - DNA, 518 bp, Unknown
  Kingdom: Bacteria, Phylum: Actinobacteria, Class: Actinobacteria, Order: Actinomycetales, Family: Micrococcaceae, Genus: Arthrobacter
gcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcaataa

SEQ ID NO: 495 - DNA, 455 bp, Unknown
  Kingdom: Bacteria, Phylum: Actinobacteria, Class: Actinobacteria, Order: Actinomycetales, Family: Micrococcaceae, Genus: Arthrobacter
tctctcggggttacagccttgctgattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagccttttttcaact

SEQ ID NO: 496 - DNA, 455 bp, Unknown; identical to SEQ ID NO: 495
  Kingdom: Bacteria, Phylum: Actinobacteria, Class: Actinobacteria, Order: Actinomycetales, Family: Micrococcaceae, Genus: Arthrobacter

SEQ ID NO: 497 - DNA, 469 bp, Unknown
  Kingdom: Bacteria, Phylum: Actinobacteria, Class: Actinobacteria, Order: Actinomycetales, Family: Micrococcaceae, Genus: Arthrobacter
ccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagcccttgcggcaagccggccccgaaatctagtggcggtctcgctgcagcttccattgcgtagtagtaaaaccctcgcaactggtacgcggcgcggccaagccgttaaacccccaacttctgaat

SEQ ID NO: 498 - DNA, 562 bp, Unknown
  Kingdom: Bacteria, Phylum: Actinobacteria, Class: Actinobacteria, Order: Actinomycetales, Family: Micrococcaceae, Genus: Arthrobacter
ggatcattcataataagtgttttatggcactttttaaatccatatccaccttgtgtgcaatgtcagtcgatcttcatggagatcgaccaaacatcaacctttattttttaactctttgtctgaaaaatattatgaataaacaattcaaaatacaactttcaacaacggatctcttggctctcgcatcgatgaagaacgcagcgaaatgcgatacgtaatgtgaattgcagaattcagtgaatcatcgaatctttgaacgcatattgcgctctttggtattccgaagagcatgcttgtttgagtatcagtaaacacctcaaagcttttggattttttaatcgaaaagctttggacttgagcaatcccaacaccaatctttttgagatcggtggcgggttgcttgaaatgcaggtgcagctggacattctcctgagctaaaagcatattcatttagtcccgtcaaacggattattacttttgctgcagctaacataaagggagtttgaccgtattggctgactgatgcaggatttcacaagggtcggcaacgattcttgttaaa

SEQ ID NO: 499 - DNA, 510 bp, Unknown
  Kingdom: Bacteria, Phylum: Actinobacteria, Class: Actinobacteria, Order: Actinomycetales, Family: Micrococcaceae, Genus: Arthrobacter
cattacattcagtagctcgctactgttagggaggccggttagtctgtatagtatcactactgatgagcagcacggccttctgtctgtacccttgtcttttgcgcactcatgtttcctcggctgggtttacgcccgccggctggacaactctataacctttttaattttcaatcagcgtctgaaaaacctaataattacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccctcaagctctgcttggtgttgggtgtttgtccactccctggtgtttggactcgccttaaagcaattggcagccagtgttttggtattgaagcgcagcacaatttgcgactctagcctagaatacttgcgtccagtaagcctttttccact

SEQ ID NO: 500 - DNA, 469 bp, Epicoccum sorghi
cctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcat

SEQ ID NO: 501 - DNA, 470 bp, Epicoccum sorghi
cctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcata

SEQ ID NO: 502 - DNA, 469 bp, Epicoccum sorghi; identical to SEQ ID NO: 500

SEQ ID NO: 503 - DNA, 472 bp, Epicoccum sorghi
cctgctatctcttacccatgtcttttgagtaccttacgtttcctcggtgggttcgcccaccgattggacaaacttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcatatc

SEQ ID NO: 504 - DNA, 476 bp, Epicoccum sorghi
ggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcat

SEQ ID NO: 505 - DNA, 479 bp, Epicoccum sorghi
ggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcatatc

SEQ ID NO: 506 - DNA, 477 bp, Epicoccum sorghi
aggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcat

SEQ ID NO: 507 - DNA, 480 bp, Epicoccum sorghi
aggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcatatc

SEQ ID NO: 508 - DNA, 438 bp, Epicoccum sorghi
acgtttccctcggtgggttcgcccaccgattggacaaatttaaacccttttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcatat

SEQ ID NO: 509 - DNA, 530 bp, Unknown
  Kingdom: Bacteria, Phylum: Actinobacteria, Class: Actinobacteria, Order: Actinomycetales, Family: Micrococcaceae, Genus: Arthrobacter
cacaaaaaatatgaaggctgtatgcggctgtgtctctttcggggggccagcttttgcggaggctgaaatatttttcacccatgtcttttgcgcacttgttgtttcctgggcgggtttcgcccgccaccaggaccacaccataaaccttttttatgcagttgcaatcagcgtcagtataacaaatgtaaatcatttacaactttcaacaacggatctcttggttctggcatcgatgaagaacgcagcgaaatgcgatacgtagtgtgaattgcagaattcagtgaatcatcgaatctttgaacgcacattgcgccctttggtattccaaagggcatgcctgttcgagcgtcatttgtaccttcaagctttgcttggtgttgggcgtcttttttttgtcttgggcctttttgtgccctgagactcgccttaaaacgattggcagccggcctactggtttcggagcgcagcacatttttgcgcttgcaatcagcaaaagaggccagccatccatcaagaccattcttctcact

SEQ ID NO: 510 - DNA, 476 bp, Unknown
  Kingdom: Bacteria, Phylum: Actinobacteria, Class: Actinobacteria, Order: Actinomycetales, Family: Micrococcaceae, Genus: Arthrobacter
aagagttgcaaaactccctaaaccattgtgaacataccttcaacgttgcttcggcgggttggctccgggtctcccggggcccccggccctactcgggcgcccgccggaggtatctaactcttgacaattgtatggcctctctgagtctttgtacttaataagtcaaaactttcaacaacggatctcttggttctggcatcgatgaagaacgcagcgaaatgcgataagtaatgtgaattgcagaattcagtgaatcatcgaatctttgaacgcacattgcgcccgccagtattctggcgggcatgcctgttcgagcgtcatttcaaccatcaagcccccggcttgtgttggggacctgcggctgccgcaggccctgaaaaccagtggcgggctcgctagtcactccgagcgtagtaatacatctcgctcagggcgtgctgcgggttccggccgttaaaaagccttatttacccaag

SEQ ID NO: 511 - DNA, 505 bp, Alternaria eichhorniae
gctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 512 - DNA, 507 bp, Alternaria eichhorniae; identical to SEQ ID NO: 488

SEQ ID NO: 513 - DNA, 507 bp, Alternaria eichhorniae; identical to SEQ ID NO: 488

SEQ ID NO: 514 - DNA, 507 bp, Alternaria eichhorniae; identical to SEQ ID NO: 488

SEQ ID NO: 515 - DNA, 508 bp, Alternaria eichhorniae; identical to SEQ ID NO: 469

SEQ ID NO: 516 - DNA, 507 bp, Alternaria eichhorniae; identical to SEQ ID NO: 488

SEQ ID NO: 517 - DNA, 507 bp, Alternaria eichhorniae; identical to SEQ ID NO: 488

SEQ ID NO: 518 - DNA, 507 bp, Alternaria eichhorniae; identical to SEQ ID NO: 488

SEQ ID NO: 519 - DNA, 508 bp, Alternaria eichhorniae; identical to SEQ ID NO: 469

SEQ ID NO: 520 - DNA, 509 bp, Alternaria eichhorniae; identical to SEQ ID NO: 483

SEQ ID NO: 521 - DNA, 507 bp, Alternaria eichhorniae; identical to SEQ ID NO: 488

SEQ ID NO: 522 - DNA, 506 bp, Alternaria eichhorniae
ggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 523 - DNA, 508 bp, Alternaria eichhorniae
cgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 524 - DNA, 508 bp, Alternaria eichhorniae; identical to SEQ ID NO: 469

SEQ ID NO: 525 - DNA, 508 bp, Alternaria eichhorniae; identical to SEQ ID NO: 469

SEQ ID NO: 526 - DNA, 508 bp, Alternaria eichhorniae
gggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccactaagcctttttttcaacttttgacctcggatcaggtagggatacccgctgaacttaagcat

SEQ ID NO: 527 - DNA, 510 bp, Alternaria eichhorniae
cgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcata

SEQ ID NO: 528 - DNA, 508 bp, Alternaria eichhorniae; identical to SEQ ID NO: 469

SEQ ID NO: 529 - DNA, 508 bp, Alternaria eichhorniae; identical to SEQ ID NO: 469

SEQ ID NO: 530 - DNA, 508 bp, Alternaria eichhorniae; identical to SEQ ID NO: 469

SEQ ID NO: 531 - DNA, 509 bp, Alternaria eichhorniae; identical to SEQ ID NO: 483

SEQ ID NO: 532 - DNA, 508 bp, Alternaria eichhorniae; identical to SEQ ID NO: 469

SEQ ID NO: 533 - DNA, 508 bp, Alternaria eichhorniae; identical to SEQ ID NO: 523

SEQ ID NO: 534 - DNA, 508 bp, Alternaria eichhorniae; identical to SEQ ID NO: 523

SEQ ID NO: 535 - DNA, 513 bp, Alternaria eichhorniae
tgaggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 536 - DNA, 507 bp, Alternaria eichhorniae; identical to SEQ ID NO: 488

SEQ ID NO: 537 - DNA, 507 bp, Alternaria eichhorniae; identical to SEQ ID NO: 488

SEQ ID NO: 538 - DNA, 507 bp, Alternaria eichhorniae
ggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcat

SEQ ID NO: 539 - DNA, 507 bp, Alternaria eichhorniae; identical to SEQ ID NO: 488

SEQ ID NO: 540 - DNA, 509 bp, Alternaria eichhorniae
gggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcata

SEQ ID NO: 541 - DNA, 499 bp, Alternaria eichhorniae
ctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcat

SEQ ID NO: 542 - DNA, 514 bp, Alternaria eichhorniae
tgaggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcat

SEQ ID NO: 543 - DNA, 508 bp, Alternaria eichhorniae; identical to SEQ ID NO: 469

SEQ ID NO: 544 - DNA, 510 bp, Alternaria eichhorniae; identical to SEQ ID NO: 485

SEQ ID NO: 545 - DNA, 508 bp, Alternaria eichhorniae; identical to SEQ ID NO: 523

SEQ ID NO: 546 - DNA, 510 bp, Alternaria eichhorniae; identical to SEQ ID NO: 485

SEQ ID NO: 547 - DNA, 509 bp, Alternaria eichhorniae; identical to SEQ ID NO: 486

SEQ ID NO: 548 - DNA, 508 bp, Alternaria eichhorniae; identical to SEQ ID NO: 469

SEQ ID NO: 549 - DNA, 508 bp, Alternaria eichhorniae; identical to SEQ ID NO: 469

SEQ ID NO: 550 - DNA, 514 bp, Alternaria eichhorniae
gggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatcata

SEQ ID NO: 551 - DNA, 511 bp, Alternaria eichhorniae
ggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcat

SEQ ID NO: 552 - DNA, 507 bp, Alternaria eichhorniae; identical to SEQ ID NO: 488

SEQ ID NO: 553 - DNA, 508 bp, Alternaria eichhorniae; identical to SEQ ID NO: 469

SEQ ID NO: 554 - DNA, 507 bp, Alternaria eichhorniae
gggctggatctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 555 - DNA, 511 bp, Alternaria eichhorniae
gggctggatctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagccttttttcaacttttgacctcggatcaggtagggatacccgctgaacttaagcatatca

SEQ ID NO: 556 - DNA, 508 bp, Alternaria eichhorniae
gcgggctggatctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagccttttttcaacttttgacctcggatcaggtagggatacccgctgaacttaagca

SEQ ID NO: 557 - DNA, 484 bp, Epicoccum sorghi
ggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgcctcaaaacaattggcagccggcgtattgatttcggagcgcagtacatctcgcgctttgcactcataacgacgacatccaaaagtacatttttacactcttgacctcggatcaggtagggatacccgctgaacttaagcatatcaataa

SEQ ID NO: 558 - DNA, 475 bp, Epicoccum sorghi
ggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgcctcaaaacaattggcagccggcgtattgatttcggagcgcagtacatctcgcgctttgcactcataacgacgacatccaaaagtacatttttacactcttgacctcggatcaggtagggatacccgctgaacttaagca

SEQ ID NO: 559 - DNA, 478 bp, Epicoccum sorghi
aggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgcctcaaaacaattggcagccggcgtattgatttcggagcgcagtacatctcgcgctttgcactcataacgacgacatccaaaagtacatttttacactcttgacctcggatcaggtagggatacccgctgaacttaagcata

SEQ ID NO: 560 - DNA, 477 bp, Epicoccum sorghi
aggctttgcctgctatctcttacccatgtcttttgagtaccttacgtttcctcggtgggttcgcccaccgattggacaaacttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcat

SEQ ID NO: 561 - DNA, 477 bp, Epicoccum sorghi
ggctttgcctgctatctcttacccatgtcttttgagtaccttacgtttcctcggtgggttcgcccaccgattggacaaatttaaaccctttgcagttgaaatcagcgtctgaaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcat

SEQ ID NO: 562 - DNA, 476 bp, Epicoccum sorghi
aggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgcctcaaaacaattggcagccggcgtattgatttcggagcgcagtacatctcgcgctttgcactcataacgacgacatccaaaagtacatttttacactcttgacctcggatcaggtagggatacccgctgaacttaagca

SEQ ID NO: 563 - DNA, 478 bp, Epicoccum sorghi
gtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgcctcaaaacaattggcagccggcgtattgatttcggagcgcagtacatctcgcgctttgcactcataacgacgacatccaaaagtacatttttacactcttgacctcggatcaggtagggatacccgctgaacttaagca

SEQ ID NO: 564 - DNA, 484 bp, Epicoccum sorghi
tgtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgcctcaaaacaattggcagccggcgtattgatttcggagcgcagtacatctcgcgctttgcactcataacgacgacatccaaaagtacatttttacactcttgacctcggatcaggtagggatacccgctgaacttaagcatatca

SEQ ID NO: 565 - DNA, 478 bp, Epicoccum sorghi; identical to SEQ ID NO: 563

SEQ ID NO: 566 - DNA, 477 bp, Epicoccum sorghi
ggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgcctcaaaacaattggcagccggcgtattgatttcggagcgcagtacatctcgcgctttgcactcataacgacgacatccaaaagtacatttttacactcttgacctcggatcaggtagggatacccgctgaacttaagcata

SEQ ID NO: 567 - DNA, 480 bp, Epicoccum sorghi
gctttgcctgctatctcttacccatgtcttttgagtaccttacgtttcctcggtgggttcgcccaccgattggacaaacttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcatatcaa

SEQ ID NO: 568 - DNA, 955 bp, Epicoccum sorghi
tcgcccttcttggtcatttagaggaagtaaaagtcgtaacaaggtttccgtaggtgaacctgcggaaggatcattacctagagttgtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgcctcaaaacaattggcagccggcgtattgatttcggagcgcagtacatctcgcgctttgcactcataacgacgacatccaaaagtacatttttacactcttgacctcggatcaggtagggatacccgctgaacttaagcatatcaataagcggaggaaagggcgaattcgtttaaacctgcaggactagtccctttagtgagggttaattctgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgcgctcttccgcttcctcgctcactgactcgctgcgctcggtcgttcggctgcggcgagcggtatcagctcactcaaaggcggtaata

SEQ ID NO: 569 - DNA, 506 bp, Fusarium redolens
ccctgtgacataccttactgttgcctcggcggatcagcccgcgcccggtaaaacgggacggcccgccagaggacccctaaactctgtttttatttgtaacttctgagtaaaaccataaataaatcaaaactttcaacaacggatctcttggttctggcatcgatgaagaacgcagcaaaatgcgataagtaatgtgaattgcagaattcagtgaatcatcgaatctttgaacgcacattgcgcccgccagtattctggcgggcatgcctgttcgagcgtcatttcaaccctcaagccctcgggtttggtgttggggatcggcgagccttatggcaagccgaccccgaaatctagtggcggtctcactgcagcctccattgcgtagtagctaacacctcgcaactggaacgcggtgcggccaagccgttaaacccccaacttctgaatgttgacctcggatcaggtaggaatacccgctgaacttaagcatatcaataagcggagga

SEQ ID NO: 570 - DNA, 287 bp, Unknown
  Kingdom: Fungi, Phylum: Glomeromycota, Class: Glomeromycetes, Order: Glomerales, Family: Glomeraceae, Genus: Glomus
aacgcaaattgcactttctggtattccggaaagtatgcctgtttgagggtcagttaaataaaaatcggtgttgttgctaccccgtagtggcgttaatgcatcggaattgagttgtcttttaccttttttggtttaagtaacttaaaattatgtacgatctttgaacgtatttaaattatttatgtacgtttataatatcaaatattaggtgcgatcatcctcatgattcacatctataattttcattatttgacctcaaatcaggtaagagtacccgctgaacttaa

SEQ ID NO: 571 - DNA, 305 bp, Unknown
  Kingdom: Fungi, Phylum: Glomeromycota, Class: Glomeromycetes, Order: Glomerales, Family: Glomeraceae, Genus: Rhizophagus
aacgcaaattgcactttttggtatcccgaaaagtatgcctgtttgagggtcagtataataaaaaatcggtatgttgcttttttttgtaacgttccggagtttgggttatcttgaacaaaattttagtttaagagacttaaaattaaccatctttttgcgcatttttagatgtacaataaattatttatttcgtctatattctcatgccaaaattttattagatgcgaccatattgagtggtttcgtgcctataaaaattttcataatttgacctcaaatcaggtaagaatacccgctgaacttaa

SEQ ID NO: 572 - DNA, 286 bp, Unknown
  Kingdom: Fungi, Phylum: Glomeromycota, Class: Glomeromycetes, Order: Glomerales, Family: Glomeraceae, Genus: Glomus
aacgcaaattgcactttctggtattccggaaagtatgcctgtttgagggtcagttaaataaaaatcggtgttgttgctactcgtagtggtgttaatgcatcggaattgagttgtctttaccttttttggtttaagtgacttaaaattatgtacgatttttgaacgtatttaaattatttatgtacgtttataatatcaaatattaggtgcgttcatccttatgattcacatctataatttttcattatttgacctcaaatcaggtaagagtacccgctgaacttaa

SEQ ID NO: 573 - DNA, 299 bp, Unknown; identical to SEQ ID NO: 446
  Kingdom: Fungi, Phylum: Basidiomycota, Class: Microbotryomycetes, Order: Sporidiobolales, Family: Sporidiobolaceae, Genus: Sporidiobolus

SEQ ID NO: 574 - DNA, 263 bp, Unknown
  Kingdom: Fungi, Phylum: Ascomycota, Class: Sordariomycetes, Order: Hypocreomycetidae_Incertae sedis, Family: Plectosphaerellaceae, Genus: Plectosphaerella
aacgcacatggcgccttccagtatcctgggaggcatgcctgtccgagcgtcgtttcaaccctcgagcccccgtggcccggcgttggggatctgccacggcaggcccctaaaaccagtggcggacccgaaggccctctcctttgcgcagtagcatcagcctcgcattgggatccctcggcgtcctgcctctaaaccccccacaagtccgctccggcggcaccaaggttgacctcggatcaggtaggaatacccgctgaacttaa

SEQ ID NO: 575 - DNA, 562 bp, Unknown
  Kingdom: Fungi, Phylum: Ascomycota, Class: Dothideomycetes, Order: Botryosphaeriales, Family: Botryosphaeriaceae, Genus: Macrophomina
cgtaggtgacctgcggaaggatcattaccgagttgattcgggctccgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagc

SEQ ID NO: 576 - DNA, 529 bp, Macrophomina phaseolina
gattcgggctccgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagca

SEQ ID NO: 577 - DNA, 527 bp, Macrophomina phaseolina
tcgggctccgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcat

SEQ ID NO: 578 - DNA, 526 bp, Macrophomina phaseolina; identical to SEQ ID NO: 449

SEQ ID NO: 579 - DNA, 530 bp, Macrophomina phaseolina
gattcgggctccgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcat

SEQ ID NO: 580 - DNA, 527 bp, Macrophomina phaseolina; identical to SEQ ID NO: 577

SEQ ID NO: 581 - DNA, 529 bp, Macrophomina phaseolina
attcgggctccgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcat

SEQ ID NO: 582 - DNA, 534 bp, Macrophomina phaseolina
cgggctccgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcatatcaataa

SEQ ID NO: 583 - DNA, 524 bp, Macrophomina phaseolina
cgggctccgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagc

SEQ ID NO: 584 - DNA, 526 bp, Macrophomina phaseolina
tcgggctcgtcccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcat

SEQ ID NO: 585 - DNA, 523 bp, Macrophomina phaseolina
gggctcgtccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcat

SEQ ID NO: 586 - DNA, 525 bp, Macrophomina phaseolina; identical to SEQ ID NO: 458

SEQ ID NO: 587 - DNA, 515 bp, Macrophomina phaseolina
ccgatcctcccaccctttgtatacctacctctgttgctttggcgggccgcggtcttccgcggccgccccccgattttggggggtggctagtgcccgccagaggactatcaaactccagtcagtaaacgttgcagtctgaaaaaaatattaaataaactaaaactttcaacaacggatctcttggttctggcatcgatgaagaacgcagcgaaatgcgataagtaatgtgaattgcagaattcagtgaatcatcgaatctttgaacgcacattgcgccccttggtattccggggggcatgcctgttcgagcgtcatttcaaccctcaagctctgcttggtattgggcaccgtcctttgcgggcgcgcctcaaagacctcggcggtggcgtcttgcctcaagcgtagtagaatacacctcgcttcggagcgtaaggcgtcgcccgccggacgaaccttctgaacttttctcaaggttgacctcggatcaggtagggatacccgctgaacttaagcat

SEQ ID NO: 588 - DNA, 452 bp, Unknown; identical to SEQ ID NO: 464
  Kingdom: Fungi, Phylum: Ascomycota, Class: Dothideomycetes, Order: Pleosporales, Family: Incertae_sedis_13, Genus: Phoma

SEQ ID NO: 589 - DNA, 509 bp, Alternaria eichhorniae; identical to SEQ ID NO: 483

SEQ ID NO: 590 - DNA, 510 bp, Alternaria eichhorniae; identical to SEQ ID NO: 485

SEQ ID NO: 591 - DNA, 511 bp, Alternaria eichhorniae; identical to SEQ ID NO: 467

SEQ ID NO: 592 - DNA, 509 bp, Alternaria eichhorniae; identical to SEQ ID NO: 540

SEQ ID NO: 593 - DNA, 507 bp, Alternaria eichhorniae; identical to SEQ ID NO: 488

SEQ ID NO: 594 - DNA, 510 bp, Alternaria eichhorniae; identical to SEQ ID NO: 485

SEQ ID NO: 595 - DNA, 508 bp, Alternaria eichhorniae; identical to SEQ ID NO: 469

SEQ ID NO: 596 - DNA, 509 bp, Alternaria eichhorniae; identical to SEQ ID NO: 540

SEQ ID NO: 597 - DNA, 511 bp, Alternaria eichhorniae; identical to SEQ ID NO: 490

SEQ ID NO: 598 - DNA, 508 bp, Alternaria eichhorniae; identical to SEQ ID NO: 469

SEQ ID NO: 599 - DNA, 508 bp, Alternaria eichhorniae
gcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagc

SEQ ID NO: 600 - DNA, 518 bp, Alternaria eichhorniae
tgaggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatatca

SEQ ID NO: 601 - DNA, 509 bp, Alternaria eichhorniae
gcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccactaagcctttttttcaacttttgacctcggatcaggtagggatacccgctgaacttaagca

SEQ ID NO: 602 - DNA, 511 bp, Alternaria eichhorniae
cgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagcatat

SEQ ID NO: 603 - DNA, 509 bp, Alternaria eichhorniae; identical to SEQ ID NO: 486

SEQ ID NO: 604 - DNA, 513 bp, Alternaria eichhorniae; identical to SEQ ID NO: 535

SEQ ID NO: 605 - DNA, 508 bp, Alternaria eichhorniae; identical to SEQ ID NO: 599

SEQ ID NO: 606 - DNA, 510 bp, Alternaria eichhorniae; identical to SEQ ID NO: 485

SEQ ID NO: 607 - DNA, 508 bp, Alternaria eichhorniae; identical to SEQ ID NO: 469

SEQ ID NO: 608 - DNA, 502 bp, Alternaria eichhorniae; identical to SEQ ID NO: 473

SEQ ID NO: 609 - DNA, 502 bp, Alternaria eichhorniae; identical to SEQ ID NO: 473

SEQ ID NO: 610 - DNA, 505 bp, Alternaria eichhorniae
ggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagc

SEQ ID NO: 611 - DNA, 510 bp, Alternaria eichhorniae; identical to SEQ ID NO: 485

SEQ ID NO: 612 - DNA, 509 bp, Alternaria eichhorniae; identical to SEQ ID NO: 486

SEQ ID NO: 613 - DNA, 510 bp, Alternaria eichhorniae; identical to SEQ ID NO: 485

SEQ ID NO: 614 - DNA, 509 bp, Alternaria eichhorniae; identical to SEQ ID NO: 486

SEQ ID NO: 615 - DNA, 509 bp, Alternaria eichhorniae; identical to SEQ ID NO: 486

SEQ ID NO: 616 - DNA, 508 bp, Alternaria eichhorniae; identical to SEQ ID NO: 469

SEQ ID NO: 617 - DNA, 498 bp, Alternaria eichhorniae
ctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 618 - DNA, 508 bp, Alternaria eichhorniae; identical to SEQ ID NO: 523

SEQ ID NO: 619 - DNA, 508 bp, Alternaria eichhorniae; identical to SEQ ID NO: 469

SEQ ID NO: 620 - DNA, 507 bp, Alternaria eichhorniae; identical to SEQ ID NO: 488

SEQ ID NO: 621 - DNA, 499 bp, Alternaria eichhorniae
cctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 622 - DNA, 514 bp, Alternaria eichhorniae
tgaggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccactaagcctttttttcaacttttgacctcggatcaggtagggatacccgctgaacttaagcat

SEQ ID NO: 623 - DNA, 508 bp, Alternaria eichhorniae; identical to SEQ ID NO: 469

SEQ ID NO: 624 - DNA, 513 bp, Alternaria eichhorniae; identical to SEQ ID NO: 535

SEQ ID NO: 625 - DNA, 513 bp, Alternaria eichhorniae
gaaggcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttcaacttttgacctcggatcaggtagggatacccgctgaacttaagca

SEQ ID NO: 626 - DNA, 514 bp, Alternaria eichhorniae; identical to SEQ ID NO: 542

SEQ ID NO: 627 - DNA, 499 bp, Alternaria eichhorniae; identical to SEQ ID NO: 541

SEQ ID NO: 628 - DNA, 509 bp, Alternaria eichhorniae
gcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagccttttttcaacttttgacctcggatcaggtagggatacccgctgaacttaagcat

SEQ ID NO: 629 - DNA, 456 bp, Unknown
  Kingdom: Fungi, Phylum: Ascomycota, Class: Dothideomycetes, Order: Pleosporales, Family: Pleosporaceae, Genus: Alternaria
ggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagcctttttttc

SEQ ID NO: 630 - DNA, 471 bp, Unknown
  Kingdom: Fungi, Phylum: Ascomycota, Class: Dothideomycetes, Order: Pleosporales, Family: Pleosporaceae, Genus: Alternaria
gcgggctggacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctggcatcgatgaagaacgcagcgaaatgcgataagtagtgtgaattgcagaattcagtgaatcatcgaatctttgaacgcacattgcgccctttggtattccaaagggcatgcctgttcgagcgtcatttgtaccctcaagctttgcttggtgttgggcgtcttgtctctagctttgctggagactcgccttaaagtaattggcagccggcctactggtttcggagcgcagcacaagtcgcactctctatcagcaaaggtctagcatccattaagccttttttccacttttgg

SEQ ID NO: 631 - DNA, 477 bp, Epicoccum sorghi; identical to SEQ ID NO: 506

SEQ ID NO: 632 - DNA, 478 bp, Epicoccum sorghi
ggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcatat

SEQ ID NO: 633 - DNA, 477 bp, Epicoccum sorghi
ggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcata

SEQ ID NO: 634 - DNA, 469 bp, Epicoccum sorghi; identical to SEQ ID NO: 500

SEQ ID NO: 635 - DNA, 468 bp, Epicoccum sorghi
ctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactcttgacctcggatcaggtagggatacccgctgaacttaagcat

SEQ ID NO: 636 - DNA, 446 bp, Unknown
  Kingdom: Fungi, Phylum: Ascomycota, Class: Dothideomycetes, Order: Pleosporales, Family: Pleosporaceae, Genus: Epicoccum
cctagagttgtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcgaaatgcgataagtagtgtgaattgcagaattcagtgaatcatcgaatctttgaacgcacattgcgccccttggtattccatggggcatgcctgttcgagcgtcatttgtaccttcaagctctgcttggtgttgggtgtttgtctcctgtagactcgccttaaaacaattggcagccggcgtattgatttcggagcgcagtacatctcgcgctttgcactcataacgacgacatccaaaagtacatttttacactc

SEQ ID NO: 637 - DNA, 490 bp, Unknown
  Kingdom: Fungi, Phylum: Ascomycota, Class: Sordariomycetes, Order: Glomerellales, Family: Plectosphaerellaceae, Genus: Acremonium
cattaccgagtgtaaaaactcccaaaccattgtgaacctaccactgttgcttcggcggcctcgccccgggcgcgttcgcgcggcccggacccaggcgtccgccggaggctccaaactcttgtcttttagtgtatttctgagtggcataagcaaataaatcaaaactttcagcaacggatctcttggttctggcatcgatgaagaacgcagcaaaatgcgataagtaatgtgaattgcagaattcagtgaatcatcgaatctttgaacgcacattgcgcccgccagtattctggcgggcatgcctgtctgagcgtcatttcaaccctcaggacccgttcgcgggacctggcgttggggatcagcctgcccctggcggcggctggccctgaaatccagtggcggttccctcgcgaactcctccgtgcagtaattaaacctctcgcggcaggatagcggttgaaccacgccgttaaaccccccacttctcaag

SEQ ID NO: 638 - DNA, 25 bp, Unknown
  primer - TSrecAf
caactgcmytgcgtatcgtcgaagg

SEQ ID NO: 639 - DNA, 27 bp, Unknown
  primer - TSrecAf
cggatctggttgatgaagatcaccatg

SEQ ID NO: 640 - DNA, 17 bp, Unknown
  primer - TSrecAf
cggtgtcctccggttct

SEQ ID NO: 641 - DNA, 19 bp, Unknown
  primer - TSrecAf
gtagatttccacgacgcgc

SEQ ID NO: 642 - DNA, 20 bp, Unknown
  primer - TSrecAf
tcgggctcgacattgcactg

We claim:

1. A synthetic composition comprising a plant element and an endophyte that is heterologously disposed to the plant element, wherein said endophyte comprises:
   i) a nucleic acid sequence that is at least 99% identical to the nucleic acid sequence shown in SEQ ID NO 198, wherein said endophyte is disposed in an amount effective to improve plant health as compared to a reference plant element not further comprising said endophyte;
   ii) a nucleic acid sequence that is at least 99% identical to the nucleic acid sequence shown in SEQ ID NO 198, wherein said endophyte is disposed in an amount effective to enrich the abundance of Alphaproteobacteria are relative to Gammaproteobacteria as compared to a reference plant element not further comprising said endophyte;
   iii) a nucleic acid sequence that is at least 99% identical to the nucleic acid sequence shown in SEQ ID NO 49, wherein said endophyte is disposed in an amount effective to improve plant health as compared to a reference plant element not further comprising said endophyte;
   iv) a nucleic acid sequence that is 100% identical to the nucleic acid sequence shown in SEQ ID NO 230 wherein said endophyte is disposed in an amount effective to improve plant health as compared to a reference plant element not further comprising said endophyte;
   v) a nucleic acid sequence that is at least 99% identical to the nucleic acid sequence shown in SEQ ID NO 317, wherein said endophyte is disposed in an amount effective to improve plant health as compared to a reference plant element not further comprising said endophyte;
   vi) a nucleic acid sequence that is at least 99% identical to the nucleic acid sequence shown in SEQ ID NO 51, wherein the endophyte is heterologously disposed to the plant element in an amount effective to increase the taxonomic diversity of the microbial community; or
   vii) a nucleic acid sequence that is at least 99% identical to the nucleic acid sequence shown in SEQ ID NO 198, wherein the endophyte treatment is heterologously disposed to the plant element in an amount effective to increase the abundance in the plant element or plant grown from the plant element, of one or more endophytes comprising a nucleic acid sequence that is at least 99% identical to a nucleic acid sequence selected from the group consisting of SEQ ID NOs. 198, 49, and 230, wherein the one or more endophytes that increase in abundance were not heterologously disposed to the plant element.

2. The composition of claim 1, wherein the plants are legumes.

3. The composition of claim 2, wherein the legume is soy.

4. The composition of claim 1, wherein the plants are monocots.

5. The composition of claim 4, wherein the monocot is corn.

6. The composition of claim 1, wherein said endophyte comprises a nucleic acid sequence that is at least 99% identical to the nucleic acid sequence shown in SEQ ID NO 198, and wherein said endophyte is disposed in an amount effective to improve plant health as compared to a reference plant element not further comprising said endophyte.

7. The composition of claim 1, wherein said endophyte comprises a nucleic acid sequence that is at least 99% identical to the nucleic acid sequence shown in SEQ ID NO 198, and wherein said endophyte is disposed in an amount effective to enrich the abundance of Alphaproteobacteria are relative to Gammaproteobacteria as compared to a reference plant element not further comprising said endophyte.

8. The composition of claim 1, wherein said endophyte comprises a nucleic acid sequence that is at least 99% identical to the nucleic acid sequence shown in SEQ ID NO 49, and wherein said endophyte is disposed in an amount effective to improve plant health as compared to a reference plant element not further comprising said endophyte.

9. The composition of claim 1, wherein said endophyte comprises a nucleic acid sequence that is 100% identical to the nucleic acid sequence shown in SEQ ID NO 230, and wherein said endophyte is disposed in an amount effective to improve plant health as compared to a reference plant element not further comprising said endophyte.

10. The composition of claim 1, wherein said endophyte comprises a nucleic acid sequence that is at least 99% identical to the nucleic acid sequence shown in SEQ ID NO 317, and wherein said endophyte is disposed in an amount effective to improve plant health as compared to a reference plant element not further comprising said endophyte.

11. The composition of claim 1, wherein said endophyte comprises a nucleic acid sequence that is at least 99% identical to the nucleic acid sequence shown in SEQ ID NO 51, and wherein the endophyte is heterologously disposed to the plant element in an amount effective to increase the taxonomic diversity of the microbial community.

12. The composition of claim 1, wherein said endophyte comprises a nucleic acid sequence that is at least 99% identical to the nucleic acid sequence shown in SEQ ID NO 198, wherein the endophyte treatment is heterologously disposed to the plant element in an amount effective to increase the abundance in the plant element or plant grown from the plant element, of one or more endophytes comprising a nucleic acid sequence that is at least 99% identical to a nucleic acid sequence selected from the group consisting of SEQ ID NOs. 198, 49, and 230, and wherein the one or more endophytes that increase in abundance were not heterologously disposed to the plant element.

* * * * *